United States Patent 7,553,954 (NUCLEIC ACID MOLECULES AND OTHER MOLECULES ASSOCIATED WITH PLANTS) - sequence listing, part 2

SEQ ID NO: 6578 - DNA, 268 bp, Triticum aestivum
  Clone ID: LIB3281-041-P1-K1-F7
gttggtttctactcagtatacttggttgctgactatgttgaagtggtcagcaagcacaatgatgacaaacagtatgtgtgggagtccaaagctgatggatcattcgctatttccgaggatacatggaatgaacccctgggccgtggaactgagatcaaactgcatctccgcgatgaggctaaggagtacttggaagaaggcaagctgaaggacttggtgaagaagtactctgagttcatcaacttccccatttacttgtgggcaacca

SEQ ID NO: 6579 - DNA, 424 bp, Triticum aestivum
  Clone ID: LIB3281-041-P1-K1-F8
gggctctggtacctcttcaacatctacttcaacatctacaacaagcaggtcctcaaggtttttccttatcccataaacatcacaacagttcagtttgctgttggaactacgatttccttgtttatgtgggccacgggtatccttaaaagaccaaagatttccggtgcacagcttcttgctatcctccctttggctattgtccataccatgggcaatcttttcaccaacatgagccttgggaaggttgcagtgtcatttacacatacaatcaaagccatggagcctttcttctcaggtctactttctgcaatgttccttggcgagctggctactccttgggttggtttgtctcttcttcctaattgtggtgggggggcattggcatctatttctgaagcttcttttaactgggctggatttttga

SEQ ID NO: 6580 - DNA, 158 bp, Triticum aestivum
  Clone ID: LIB3281-041-P1-K1-G10
cggacgcgtgggcagacgcatatgaaacacaagtcggtccagccggataggcgtagactgatgaactaaagatcatactctatatcggtgaggctgatggtcaaactgcaggagttctttgactgaccaagtcacgggaggacttgatgcgcatagct

SEQ ID NO: 6581 - DNA, 386 bp, Triticum aestivum
  Clone ID: LIB3281-041-P1-K1-G11
cccaaccaacggagcccaactccagcgccgatttcctctgccccagccactcggcctcgccggcgcggcggcctcctctcccccatccatgccgctgacctccctctccttctctcccatggcgccgaaaccctagccacggcgacctagcagcagcaggcaggacgagcccggctatggccatggcctcctcttcccctctgccctgccacggccgccgctccagcccctcctctcctctcctctcctctcctctcctcttcacttctctcccaagggaggggaggggaggggagggaagggaagccaaggccccagatcaagcggagcggcgcccaaatccgcccacagcggcaccggcgatctgatccgcgaccctcctcgag

SEQ ID NO: 6582 - DNA, 328 bp, Triticum aestivum
  Clone ID: LIB3281-041-P1-K1-G12
cccaaccatcggagcccaacttcagcgccgatttcctctgccccatccactggggctcgccggcgcggcggcctcctctcccccatccatgccgttgacctccctcttcttctctcccatggcgccgtatccctatccacggcgacctatcttcatcatgcaggacgagccctgctatggccatggcctcctttttccctctgccctgccacggccgccgctccagcccctcctcttctttactattctctcctcttcttttcacttttctcccaagggagtggaggagaaggtgtgggaagggtagccaatgtcccatatcaagctg

SEQ ID NO: 6583 - DNA, 157 bp, Triticum aestivum
  Clone ID: LIB3281-041-P1-K1-G2
ctccgccccccaacccaaaccctaccccgccgccgtcgtcgtcgacgcatcgcgcggaggcgacctcccaccgccggcaagatgcagatcttcgtgaagaccctgacgggcaagaccatcacgctggaggtggagtcctctgacaccatcgacaacg

SEQ ID NO: 6584 - DNA, 247 bp, Triticum aestivum
  Clone ID: LIB3281-041-P1-K1-G3
cccacgcgtccggtgtgtttggtcgccatgtatcctccaattcatcagtgctccaatggtcataccatttgttctggatgcaagccaagggttcataatcgctgtccaacttgcaggagtgaattgggtaacataagatgccttgctctagagaaggttgctgcctctctagaggttccatgcaagttccagaactttggatgcgtgggaatatatccttattattgcaagctgaagcatgaatcac

SEQ ID NO: 6585 - DNA, 293 bp, Triticum aestivum
  Clone ID: LIB3281-041-P1-K1-G4
gctgaaaccctagccgcgagccgcatctaatttgagcccggttccaccagcgacgtctcgccggagacgccgctgacacctcgacggaaccgacgccttccaccgcctacgcggaccttaccgtcgcgcaatccagggttcgatggccgcgtcgtctccggcctccagcggcaaggcggcgagcgactccttcgcttctgctgcgggccctttccccgtggtattcaatggcaatggaacgccgcagaagccgccccccgtcggcggattcgacatgcccaagcccaaccttc

SEQ ID NO: 6586 - DNA, 330 bp, Triticum aestivum
  Clone ID: LIB3281-041-P1-K1-G6
cccacgcgtgcgctgtctcttggctcatgattgacaggggatgtagctaggagagagaggctgcgccgaagttaatgtagaacggccacactcgtatctcctaaataattaccaccaagcgctttgttgcggcgacattaagaacctacccttctatgagacgattaaatgcacgtggcacgtgacagacatctactcgcgcgccaatcaaagcggcggagatacaagacccaacacacggcgttgtttcaaatgatgccatcagcacgaatgaagggcgctttctatgacaatgctgatgctcaccgtcattgctttggcagattcaga

SEQ ID NO: 6587 - DNA, 230 bp, Triticum aestivum
  unsure (1)...(230): unsure at all n locations
  Clone ID: LIB3281-041-P1-K1-G7
cccacgcgtncgcaaaggctttggatttgttcagtatgagaaagaagagtctgcacagtctgcaatgaaaagcctaaatggcatgcttatcaacgataagcctgtctatgttggaccttttctccgcaagcaagagagagataattcttttgacaaggcaaaatttaacaatgtctttgtgaagaatttatctgagtctactacaaaagatgatctagtcaaagtattca

SEQ ID NO: 6588 - DNA, 153 bp, Triticum aestivum
  Clone ID: LIB3281-041-P1-K1-G8
gcgcccacacgtaagcctacgcgtggcggtcgcagtcgtagacagcaatacgaggaggcgcggggtcacacacggaaggtttcaggtcttcttgcagacccttacgggcatatacattacccttgagggggggtgcttcaacacctatcgact

SEQ ID NO: 6589 - DNA, 227 bp, Triticum aestivum
  unsure (1)...(227): unsure at all n locations
  Clone ID: LIB3281-041-P1-K1-G9
caccccatctcgccgctgccagacctaaccctcgcctccgccgccagacctaaccctcgccgccaccgctgccgccgcagcagcggtcgccgcctttgtcgtcccactccgctgctccaggccggcgcatccacccttgagactgcacatcccctcgtttcttgtaccttctctatcctctcgccggtcaagcgaaccacaccttgtnctnctcgcgcctacgcgca

SEQ ID NO: 6590 - DNA, 308 bp, Triticum aestivum
  Clone ID: LIB3281-041-P1-K1-H1
ccacttgatgtcgctgtcgtccacaccaccattattgcccctgtctgtcactgttgctatccggccgtaattaggtgtgcattattgttcggtgccgaagttgatggctgctgctggtatggttgtgcttgtagttgttggctggtttttgcgcgcggcagcaagacagaatcggcgccaagtgatgtgatgtctgcgtctgccaatagggtattaattctttggataacaatactatgttgttcggaaattcatggtgggatggcttcgcctggacaaataaaaaaaattataaaaatttttgtaaa

SEQ ID NO: 6591 - DNA, 126 bp, Triticum aestivum
  Clone ID: LIB3281-041-P1-K1-H10
gtggaagcgtcgcgttctcttgcttgtttcccaagaagaagaaggagaagagcggcgtctgatctcgtcagcggcgatggctgcgattcggcttctgatcccgtccttcaaccgggtgctggtgga

SEQ ID NO: 6592 - DNA, 426 bp, Triticum aestivum
  Clone ID: LIB3281-041-P1-K1-H11
cccacgcgtccgcggacgcgtgggattgaaactgagaaaatgcttattgccatggttgaaactgaattggagaagagaagagcggcggggaagtactctgcacatttcagaggccagtctcacttcttcggatatgaaggaaggtgcggcctccctaccaattttgattccagctattgctatgcattaggctatggtgctggtgctcttctccaatttggcaagacaggacttatttcgtcggttggtaacctggctgctcctgtggaagaatggactgttggaggaactgcactgactgcgttgatggatgttgagaggaggcatggcaagaacaagccagtgatcaagaaggctatggtggaacttgatgctgcgccatttaagaagtttgcctcgctgcgagatgaatgggccagcaagaac

SEQ ID NO: 6593 - DNA, 441 bp, Triticum aestivum
  Clone ID: LIB3281-041-P1-K1-H12
cgccacgcgtacgggcatatatgacctgggacctggtaggtttcggtataccgacgcgtgaatctgccctggaaaacagtagagcgtcgggaaaacactcttgacatttcagagatcctgtctgacttattaggatcacaaggaaggtgcggcctctttacctaatttgataccagctattgctatgcattaggctatggtgctggtgctcttttccaatttggcaagacaggtctcattctttttgtaggtaacctaactgctcctttggaagaatggactgttgtaagaacttctctgactgctttgatggattgtttgaggatgcattaatagaacaatgcagcgatcatttttgcttttgtgggaactttatgttgtgccattttatgaaatttatttttctccgagtttgttggtgcctatttattccctttcatt

SEQ ID NO: 6594 - DNA, 174 bp, Triticum aestivum
  Clone ID: LIB3281-041-P1-K1-H2
cggacgcgtggggtcccaacccgatccgatctcccccctcctcctccgtcgtcatgggccgcaagttcttcgtcggcggcaactggaaatgcaatggaactgtcgaacaggtagagagcatcgtcaatactctgaacgctggacagatcgcctctacggatgttgtcgaggttg

SEQ ID NO: 6595 - DNA, 134 bp, Triticum aestivum
  Clone ID: LIB3281-041-P1-K1-H3
cccacgcgttcggtgcgtacgctcgccatgtatcctcctattcatcagtgctccaatggtcataccatttggtctggatgcaagccaagggctcataatcgctgtcccacttgcaggagtggattgggtttcat

SEQ ID NO: 6596 - DNA, 326 bp, Triticum aestivum
  Clone ID: LIB3281-041-P1-K1-H4
cgtgcttcttccgctctccgctgctccaaccctagtggccgccccctgggccctggtaatcgtgggttggttgtggcggccaccggttccctgacaaggtgacaccaaagccaccattgtcaaagccggcgttggccggcgttgccactggtcgctgctccacgcatcttgtcggtgctgcgaggcgatgccatctacatatgttgctgcagcctgggaggtggcagggtctccaggtgatgccctctttgctggccaatcggtgaagatgccatatgacgagatcctctgctgctgctgtgtctggtggttgaagaaagggtgtg

SEQ ID NO: 6597 - DNA, 150 bp, Triticum aestivum
  Clone ID: LIB3281-041-P1-K1-H5
cccccaagaaaaaaaggggcccgaaaatttttccaaagggttctaccttgtctgctaggttgcccggcccccccatataccttctcctaatttgcttggagttcttccggacggtcgcctaatggtttaaaaattttccgcatttattga

SEQ ID NO: 6598 - DNA, 395 bp, Triticum aestivum
  unsure (1)...(395): unsure at all n locations
  Clone ID: LIB3281-041-P1-K1-H6
acgccgtcacgggtgcgggactgtgatgggcatatatgacctgggacctggtaggtttggttcagaggctgtctttgtgcccaaggagcccggtgtttctggggaagaagacgatggctatctgatattctttgtgcacgatgagaacacagggaaatctgaagtgaatgtgattgatgccaagaccatgtctcctgatccggtggcggttgtcgagctgccgaaccgggttccttacgggttccacgccttctttgtcaacgaggaacaactggtacatcagcaagcagaggtgtgaagaacagtgataaaaaagactctgcgtggtctgcatgctgcagaaataaaggaaagaaagcagtncatagtacattggtacaatatatataggatta

SEQ ID NO: 6599 - DNA, 236 bp, Triticum aestivum
  Clone ID: LIB3281-041-P1-K1-H9
agggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtttgacgaggcgatgccccaagcgatcgaggccattaacggtc

SEQ ID NO: 6600 - DNA, 285 bp, Triticum aestivum
  Clone ID: LIB3281-042-P1-K1-A1
acatgtaggggtggtgctataccgtttacaaacatcccgggtttcgtggcgggataagtgatgctcctaagaaagtaccctttgcccacatggatcctgagagcggatccatttatgcccacgggatattcacatcttaagaagacttgataatccaaatgttattaacctcgcaggtttggtgacattacgcatgtcttgtagctcgtttcttctgttccaatacatggagcatgatcttgccggacttgttggtacacctggggttaaaatttacatttaggg

SEQ ID NO: 6601 - DNA, 389 bp, Triticum aestivum
  unsure (1)...(389): unsure at all n locations
  Clone ID: LIB3281-042-P1-K1-A10
cggacgcgtgggggaaaagcaaacttccaagcggctaggtctcccaaatccgtggccgcctgagctcggcagccatggcttcccacccgccgccgccgtcgtcgccggcgccgccggagtaccctatcccacccgctcccaccaccataagtgccctcgacgacgaccagctccgagagatcttcctccgcctcccggacctccccagtctcgcctccgccgacttcacctgccgcgcattcctcggcgccgtccgttcgtgccgcgcctttcgccgcagctttcgtgcgctccacgcgcccccgctccttgctctcttcctcacaccctacatgcgcacggtacctacctttcccgncttacgcccccncactgccgccagattcagt

SEQ ID NO: 6602 - DNA, 362 bp, Triticum aestivum
  unsure (1)...(362): unsure at all n locations
  Clone ID: LIB3281-042-P1-K1-A12
cgnccactggacgctaacttaataaagacagactggcgttgtcgctaggcacccacttttgcatttggttctatccttgatggcccatcccttgagaaacttgctcccctggtacaggccggacttgatttcttgctcaatacaatgaatgatccaaacagccaggtaaaagacaccactgcatggactcttggacgggtatttgagcttttgcattctccatgcagtactaatccaatcatatcaaatgcacaccttcctcgcatcatggctgtcttgctagagagtagcaaagatgttccaaatgtggctgagaaagtctgtggagccatatattttcttgcccaaggttatgaaaatgc

SEQ ID NO: 6603 - DNA, 259 bp, Triticum aestivum
  Clone ID: LIB3281-042-P1-K1-A2
acacgaaggggcggtcatcagcgtatacaaagctcgcgatcttcagaatggaaaaattgtggcacttaagaaagctcgatttggcaacatggatcctgagagtgttcgatttatggcgagggaaattcacatcttaagaagacttgataatccaaatgttattaagctcgaaggtttggtgacatcacgcatgtctagtagcttgtatctcgtgttcgaatacatggagcatgatcttgcgggacttgctgctacacct

SEQ ID NO: 6604 - DNA, 340 bp, Triticum aestivum
  Clone ID: LIB3281-042-P1-K1-A4
ctgttttttaaaatactgctcacccagatagggtttagctggctgcgccgccgcctgccgacagcgatttccccccatggcgctgcctaaccagaacaccgtcgattaccccaacttcaagctcgtcatcgtcggcgatggcgggactggcaaaaccactttggtgaagaggcatcgttactggagagtttgagaagaaatatgagcccactattggtgtcgaaggtcacccatcggattgcaccactaactggggaaagatcctgttctactgccgggacactgctgggcaagagaagtttggtggccttagggatggttctatctccatggacagggt

SEQ ID NO: 6605 - DNA, 381 bp, Triticum aestivum
  Clone ID: LIB3281-042-P1-K1-A6
cggacgcgtggggatccatttacaaaaacaacatctgtagttgaatattatcacattcttccgtataaggagattttgcttgaactcctccacaggaaatggccttgtgattctccactgaacgaacaatcacatcgacatggaaaaggttcattgcactctgtaatagatgaaaatgtggaagagcaagatgcgaatagcacgtataagatgcaaaaacgaattacaaaagtgtcaactccaaagcaaagcaaacaagcaattgctgccaatagcaaccatgactacaggaccagcatgcacaagataaacagctaatgaaaatctgaagcctccagggccgatgtctgtgcaaagggttcagatgcttgaatccacaca

SEQ ID NO: 6606 - DNA, 320 bp, Triticum aestivum
  Clone ID: LIB3281-042-P1-K1-A7
gcttaaggggcgtagatatgcgtttacaaacatcgcgatcttcagaacgggaaaatgaaatcactcaagaaagctacatttagcaacatggatgctgatagcggttgatttatggcgagagaaatacacatgttaagaagacttgataatccaaatagttattaagctcgaaggtttgatgacatcacgcatgtctagtagcttgtatatagtgttcgaatacatggagcatgatcttgcgggacttgctgctacacctgtcataaaattcacagaggctcatgtcaagtgttacatgcaccagctactgtctggacttg

SEQ ID NO: 6607 - DNA, 313 bp, Triticum aestivum
  Clone ID: LIB3281-042-P1-K1-A8
acggttcctacatcagcgtttacaaagcacgcgatcttgagaatggaaaaattgtggcacttaagaaagttcgatttgccaacatggatcctgagagtgttcgatttatggcgagggaaattcacatcttaagaagacttgataatccaaatgttattaagctcgaaggtttggtgacatcacgcatgtctagtagcttgtatctcgtgttcgaatacatggagcatgatcttgcgggacttgctgctacacctggcataaaattcacagaggctcaggtcaagtgttacatgcaccaacttctgtctggact

SEQ ID NO: 6608 - DNA, 392 bp, Triticum aestivum
  Clone ID: LIB3281-042-P1-K1-A9
cggacgcgtgggcgtgtactcaataagagcaacccaggttcctcgagcatcagctagtgcagtagcatttggtttggggctactttctgggaaaggaaagcttggagcaggaaataaccgtgccttctctgttctgagcgagagtcgtgcaagtgatatttgtctgcgattctttgatagctgtaaaacatacaaggactacaggaaaagaaaggaacctgatgttgacaagcaaaaggaaccaattctagaacatgtcacatctgctttagtcagccgttatcacctcaagtttacaacacaggatgtttcttccctctggttcctctgcaaacaggaagcatctttactgaatattaccaatcaagcttgtcaacttttcaatgaagatg

SEQ ID NO: 6609 - DNA, 398 bp, Triticum aestivum
  Clone ID: LIB3281-042-P1-K1-B1
cccacgcgtccgcggacgcgtgggccatcagcgataaggatcgctgtgggcagtgcaaaggtgagaaggtggtgcacgagaagaaagtcctggaggtggtggttgagaagggaatgcagcatggacagaagatcaccttccccggcgaggcggatgaagcgcctgataccgttactggagacataatcttcgtcctccagcagaaggagcaccccaaattcaagcggaagggtgatgacctcttctacgagcacaccctgaccctgactgaggccctgtgtggcttccagtatgtcctggctcatttggacggcaggcagctgctcatcaagtccaaccctggcgaagtggtcaagcctgattcattcaaggcgatcaacgatgatggcatgcccatg

SEQ ID NO: 6610 - DNA, 286 bp, Triticum aestivum
  Clone ID: LIB3281-042-P1-K1-B11
atgacctatttagaccagaatgactgtgtgcactatgctaagatgactgaagaatgtggagtggaagttcagattgctggtgatgaccttctagtcaccaacccaaccagagttgcaaaggcaatcaaggagaagtcatgcaatgctcttctgctgaaggttaaccatattgcatccggaactgagagccttatgggcttgacattataagaaaatggcatgacacttgatctttcaagaacttcaagaagtggggatatttacaattccctctatgattcggctg

SEQ ID NO: 6611 - DNA, 360 bp, Triticum aestivum
  Clone ID: LIB3281-042-P1-K1-B12
ttcaattttagttcccgcaaaaaatatcaattttaatcggaatcttgtgtcataggtggcacatgtcatcttctgggtggagcgaacaccgaacacttctccgtggtgccttgggacgtgtctcctgccacgtctaaatatcgtcacagacgaggtgtgctccaaatcgatctgggccaagtccatggctcgtcgtgctgcggaggcactgctcgtcctcggcttcctcttcttacccctcacggcgtcgagctttctcgtcccagagagccggcgccggtccgacgaggtgctcggcattaccctcggcgcgacccactcgtgcattgccgccgtacaccgggacggctccatcgagat

SEQ ID NO: 6612 - DNA, 398 bp, Triticum aestivum
  Clone ID: LIB3281-042-P1-K1-B3
cacccctgacctcccttccgcatccacgcgagcgaagccgcgccggcgaagagcaggcgaaccttctacaaccctccgactccgagcccccttccgcggcccgcagccatggcgaccgtcatgcagaagatcaaggacatcgaggacgagatgtcaaagacgcagaaaaacaaagccactgcacaccatcttggtcttctcaaggctaaacttgcaaaattacggcgagagttgctcactcctacaaccaaaggtggtggtggtgccggtgaggggttcgacgtgacaaaaagtggagatgcacgtgttggtttggtgggctttccttcggttgggaaatcaacattgttgaacaagctgacaggaactttctcaggaagtgcgtcccatgagtttac

SEQ ID NO: 6613 - DNA, 368 bp, Triticum aestivum
  Clone ID: LIB3281-042-P1-K1-B4
gccccacgcgttcggacgggagaaataaaaagggttaccatagatgatatggcgcttcatcatgaggttcaagtccctgctgtcgatcaaccgataatcttgtcgagtgcgaacccgcataagttgctgctccaaaccatacaatttggaggatgaacgcgagtctcccagcgatgccatggttagcactgttctttcagttgtctctgtttcataccatacaattcatttaggcaaaattctggagccactatcattcatactgtatttggcatggtagtggacagtcagaaccttacggtcttgcaacatcctcagaataaatatcctgctccaatcatgttctatgtatattctgtcatacacgg

SEQ ID NO: 6614 - DNA, 401 bp, Triticum aestivum
  Clone ID: LIB3281-042-P1-K1-B5
cgcaattccgggattgccgggtgcgcccacgcgtccgcttctcagtcagaagaaagactgtgaagccaatgacacctgatgcttgagcgtcccttgattgcaacccttccactggaggcacgcggaaagattggtgatttcatcaaaggagtgtttgctgtcttccaagacttagatttctcatttattgagatgaacccattcaccatggtgaatggggagccatatccgctggacatgagaggagaattggatgacactgcatctttcaagaacttcaagaagtggggaaatttagaattccctctaccattcggcagagttctcagttctacagaaagttttatccatgagctggacgataagaccagcgcgtctttgaagttcacagttttgaaccc

SEQ ID NO: 6615 - DNA, 390 bp, Triticum aestivum
  unsure (1)...(390): unsure at all n locations
  Clone ID: LIB3281-042-P1-K1-B6
ccggaccggnccgggagacccaggcggacccacacgtccgatttaaccaggatgtctgagtgctctatactttaatcactgagctatgtgtagtgtgggagatgtcatcttctggttggagtgaacaccaaaccccccccccagaggcgcaggggctctcaaggagaagtcatgcaatgctcttctgctgaaggttaaccaaattggatccgtcactgagagtatcgaggccgtgaagatgtcaaaacatgccggttggggtgtgatgaccagtcacaggagtggtgagactgacgacacattcattgctgatttggctgtcggtttgtccacgggtcagatcaagactggggctccctgccgctcagagcggcttgccaagtacaacca

SEQ ID NO: 6616 - DNA, 283 bp, Triticum aestivum
  Clone ID: LIB3281-042-P1-K1-B7
ctgcgattcgaaatactccttccccagctagggttttgctgcctccgccgtcgactgccgacagcgttgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggatttcaccactaactgtggaaagatccgtttctactgctgggacact

SEQ ID NO: 6617 - DNA, 315 bp, Triticum aestivum
  Clone ID: LIB3281-042-P1-K1-B8
cccacgcgtgcgtataacccccgcagccgccgccgctcctgccgctctctttctcccttggccaaattttgcgggaaacgcgacgccacccggagaaaccctcctgccgcacctcgcctcccaccctgccaaaacccttgcccctgctgctcctgctcctactacgatgggcgcgccgacgcctacggccgccgccgcccccggcgcggcgccaggaccgacgccgtcggcgcaagtggtgggcaacgccttcgtgcagcagtactacaacatcctccaccagtcaccggagctcgtgttccgcttctaccaaga

SEQ ID NO: 6618 - DNA, 305 bp, Triticum aestivum
  Clone ID: LIB3281-042-P1-K1-B9
cccacgcgttcgtataacccccgcagccgacgtcgctcctcgggctctcttagttcctggggcaaattttgcgggaaacacgacgccacccgaagaaacccttctcccgcacctcgtctgccaccctgacaaaacccttggccctcctcctccgacttctactacaatggccgcacaaacgcctaggcccgccgccggccccgactcggggccaggaccgaccccaacatctcaagtggtgaacaacgccttcgtgcattagtcctacaacatcctacactagacaccggttctaaaaatcccgc

SEQ ID NO: 6619 - DNA, 393 bp, Triticum aestivum
  Clone ID: LIB3281-042-P1-K1-C1
cggacgcgtgggcgagaaggtgaaatgcaagatctgaatcaagaaaaccgccggcgatgggctgcatgggccggtgctgggacaaatgcaagtggccactagcgtgcttcgccgccctcgccgccgtcatcatcatcgtcgtcatggtcgccgcctacagcttcgccatccagccatccatcaccgtcgaggacgcctcgctggccaggttcgcgctggcgaccaccccgacgacgtcgctcgggtacaacctctcgctgcggctcgtcgtccgcaaccggaactgggcgacgaccatgaagaacacggagccgctggaggcggcgtacaagttcgacgggcagcagttcgaccgcgtgcaggtcgccgacaagggcgacaagcacggcccca

SEQ ID NO: 6620 - DNA, 370 bp, Triticum aestivum
  Clone ID: LIB3281-042-P1-K1-C10
cccacgcgtccgcccacgcgtccgcccacgcgtccgcccacgcgtccgcaaactggccacgaccaacacccacagcccggatccagatcttctttcttcttcgtcggctcaccagggaaggacccggcataccgtcggtcgagccgattcttgtgagcgggtcgctcatcggtcatcacgcgatggctcgcgcggcgaacgtcgacgtgcccgctgccggcgcggcgcagggcggggcgaggaaagcggaggggttggcggccgtggccggcgacggcaggagggtcgaccaggccgtggcgtacctgctcatggccgccgcgcttgccgtcacctacctcgtgcactgatcgaccggtcagtcgacgga

SEQ ID NO: 6621 - DNA, 367 bp, Triticum aestivum
  Clone ID: LIB3281-042-P1-K1-C11
cggacgcgtgggcgcgccgccgccgcagccgcctccgtctccgccgccacgatgccgtcgcacaagaccttccggatcaagcagaagctggccaagaagcagcgccagaaccgccccatcccctactggatccgcatgaggaccgacaacaccatcaggtacaacgccaagcgcaggcactggcgccgcaccaagctcggattctaagccggggatgacgatgatgacgcccgttgccgccgacgggagaagggtctagggtacctagggtttatggcgtctcgttgtttttgcaagctagcatgtgactccgggatgcctgttttaagattaagatttcgcttgtgttgagagatattattattta

SEQ ID NO: 6622 - DNA, 376 bp, Triticum aestivum
  Clone ID: LIB3281-042-P1-K1-C12
gcgccctccagctgctcacagatcccggccatctctccgtcgacaaccgcacctgcgcgtgcaccctccgtcccgaaccagaagatggctattgccggcagtgggaggggcaaggcgaagcccgcctgcagcgccaagtccgtgtcacggtcgttcaaggccggcctgcagttccccgtctggcgcgtcgcccggttcctaaaggtcggcaagtacgcgcagcgcgtcggcgccggcccccccgtctacctgggcgtcgtcctcgtgtaccttgctgccgagaccctggagctcgccctgaacgcggcgcgcgacaataagaagaaccggatcgtgccgcgccacatgcagctggcggtgcgcaacgacgaggagc

SEQ ID NO: 6623 - DNA, 263 bp, Triticum aestivum
  Clone ID: LIB3281-042-P1-K1-C2
ccccagcccaggccaaatccaaccagacccgatccccacgcgcattccccgtaccggatccgatcgttcgaccgaccgcgccgcgcgaccgccggggggagagagggagagcatggctagcggaggcaggacggatctggacggcgccgccgtggcgccgctgaccatctgcgtgatcggcgcccgcggcttcactcgctcgcacctagtggagaagctcatggccgagacccagcacacggtcctagccgtcgacgtctact

SEQ ID NO: 6624 - DNA, 229 bp, Triticum aestivum
  Clone ID: LIB3281-042-P1-K1-C3
cgcacgtgtgccggcgcctctgccattctccgagccaagttcttactctgaccattcatgtgtccacgccggtcgaggggagcatctacgggagcatatctccggcaatagctgccgcaggataaagcgggctatagtaggggagtcctaaggggagtgacagggggtgagaccgggcaatataaaccgctcaatatactgctccataacccctgctgatactgccgct

SEQ ID NO: 6625 - DNA, 315 bp, Triticum aestivum
  Clone ID: LIB3281-042-P1-K1-C4
acgcactcgtttggccaactttatttttcgcgtgctctcacacttgctgccacgcgttcaggggctggtttgttcaacacccacagcccggatccagatcttctttctttttcgtcgggtcaccagggaaggacccggcctaccgccgggcgagccgattcttgtgagcgggtccctaatccggatagaacgctgcctggggcgattttgaattgtgggcccgctgccggcgcggcgcatggcggggcgaggtaagcggttgggttggcggccgttggcggcgacgcaggagggtcgaccaggccgtggcgtacc

SEQ ID NO: 6626 - DNA, 381 bp, Triticum aestivum
  Clone ID: LIB3281-042-P1-K1-C5
ccaaaacaaggcatgcttattcatgttccttcttttgaaacaattgacgacacattagccaacatgtcacttaaatttatgcgaataatagttcagtattcatcatccttccatcatcataaaataagaatacagttcataaggtcaaaacaaaattagaagaactcttaacaaaagtaaccaacacttccaacaatgttaaatcaaggagttgaggtgttggaaatcagcttgtcctcactatatgattcttttttcctcttctcctcatccatctccattgaggagtaactaacacttccaacagcttcaatgttaaatcagcaacttgtgtcaaaccgtgagcactccgggtacagaatctttgcttgatgatcctcc

SEQ ID NO: 6627 - DNA, 377 bp, Triticum aestivum
  Clone ID: LIB3281-042-P1-K1-C6
caggtggactgcatgggctagctaaccttactaaaccagttcttgaggctgtcatctttcttgagtcgatctttcagtctgagaagcgtattgatttgttagaatcactggtggagaagtttcttacagctgaacagactcaaggggagctggcaagcttaagcgacaaagaagaattatcttccatatattcagagtttttggatacgtttggggatgtacagtcaatcaagaaggctacaactcgacatactattctcttttcacgtaaaatgagcactctgccatcaaagaaacgaagagcagatgatgctgtcatgtccggtagagataaaatggccaaaaccggagatggcacccaaccaggcatgggaact

SEQ ID NO: 6628 - DNA, 347 bp, Triticum aestivum
  Clone ID: LIB3281-042-P1-K1-C8
gtggtatgggtgcatactcccctgcgccaatagtgaccgaagagcttaagagcgtgatcatggaaactataattactccaactgttaaaggtatggctgctgaaggatgcaagtttgttggtgtattatatgccgggcttatgattgagaagaaatctggtctgcctaaacttattgaatataatgtgcgatttggggatcctgaatgccaggttctgatgatgagattggagtctgatcttgcacaggtcctgctatctgcatgcagaggagaactgggtaaggtttcgctaacctggtcacctgaaatcgcgatggtggttgtgatggcgagcgaatgataccct

SEQ ID NO: 6629 - DNA, 288 bp, Triticum aestivum
  Clone ID: LIB3281-042-P1-K1-C9
gtgatacgggagcatactaccttcaccgagcacgcccggcggaggaccggaaccggcatggacgaactatactcactcaaactcgcaaagacgctccctgtacagatgacggaggcttggccgtgccttatcagtcgaatccatctaggccaacaagattggattgagctaagccatggaatgatcatgggcgatgggctgaggcggaatggaatggccggatgatgatactggatgctgattttacacactacctgcatggaagtagacaataggagaacttggacc

SEQ ID NO: 6630 - DNA, 157 bp, Triticum aestivum
  Clone ID: LIB3281-042-P1-K1-D10
ccaggccctagtcaaaataagaatgggagcgccctccttcttctcttacaggtggcttgggagctccctcgccccctgttggataattcaagtggttctcctcatcagcctgtgctacagatgttttctgcttcatccctgttgtgtatccactgtg

SEQ ID NO: 6631 - DNA, 371 bp, Triticum aestivum
  Clone ID: LIB3281-042-P1-K1-D12
ccgaaacccaaaccccagactgagcgacagagagcagccagcagcctgctccgccgtcaccaatgtgtggatgagggttcccccgggggccactcccagaagcgccacaaccgtgctcgcgcacccggccaagtagtttgagtccggcgccaccgatctcagggccacggcgttggacggcctgggcgccatcgccggactggtggccgggcggctcttctaaacgggcgaggacagggtggaggcagtgcaacgctgtacgttaggttgcatgtagcccatcagctcatcgagtcacgcgcttctcgtttgttgaggaggccatctttcttttgacggaagggactggcttttgctgtgggttgcacacg

SEQ ID NO: 6632 - DNA, 195 bp, Triticum aestivum
  Clone ID: LIB3281-042-P1-K1-D2
cccacgcgtccgcggactcgtgggtgacgacatggcctcgccggcgagcggcgattccaatcatgtactgtgtggaagcaaattgctctacacggacattggttttgaataggccaaagcatgttaaatgctctctcctctgcattggttacgggacttcttaaatgcttcactccttatgaggaagtaaacaca

SEQ ID NO: 6633 - DNA, 339 bp, Triticum aestivum
  Clone ID: LIB3281-042-P1-K1-D3
aacatagctaagtgagaagtgatagaccattgagacctatgcgcgctaataggtttccaccagagacactggaggatagtgcagaacctaagttgctcagcaccatatcattggcagactttcataaaataaccaccaacatacagtacttgaagatgatttttaagaaaaatagcagatttgccttttaataggaataagtaaaagaactaaatttaaataacaaattacagtatcagataaatgtttctttaagaaaagctgcagctttgcctcatgattcgtacgaaagaatcatgaatcatctaatgattttttctttgcaggtgataaatcaag

SEQ ID NO: 6634 - DNA, 305 bp, Triticum aestivum
  unsure (1)...(305): unsure at all n locations
  Clone ID: LIB3281-042-P1-K1-D4
gcctgaggtaccgggcaggtactggtcggtagtcccaggcgcgacgccaggcgtctcagagaggacctggacaaagctcaggtactcagggatcaactgctgacagttatccatgatgaagacacggcgcacgtacagcttgaccaatgactgggaggagcatttggctgtcaagcacttctctgttgagggtcagcttgagttcaaggctgtcctgtttgtgcccaagagggcccccttcgacctctccganaacaagaagaaggccaacatcatcaagctgtccgtgcgccacgtttttatta

SEQ ID NO: 6635 - DNA, 383 bp, Triticum aestivum
  Clone ID: LIB3281-042-P1-K1-D5
cccacgcgtccgcggacgcgtgggctctctagacactaaacaaaagaggggggaagaaaagctcgcaccacccaacaccatatagttactcccccctcccccctccccaggagcttgctagctggagcagcaacagcagcagccagccaccgccgcaaatccaagaaatccgccgcatccgccgccgccgacgagcagcagcagcagcagatagagcagctagagcagaggaggcgctccgccatgggtgcgccggcgtacggcgccgtgctcctcttcgcgctcgcgctggccgtggccgcgggagctgctgagacggcgcggccggaggaacccacattgcccgccgtggccgccgctagatgtggtggcgagggggtggt

SEQ ID NO: 6636 - DNA, 308 bp, Triticum aestivum
  unsure (1)...(308): unsure at all n locations
  Clone ID: LIB3281-042-P1-K1-D6
gcatacatgagcctgctgcgccgccgcccatgttaggaggagggatcgcgcggggccgcctcgcggaggagcgcaaggcctggcgcaagaaccacccccatggattcgtcgcgaagccggagacggtggccgacgggtcggtgaatctcatgatctggaactgcaccatccccggaaagcaggggactgattgggaaagtggatactacccacttactctccatttcagtgaggactaccctagcaaaccttccatgtgcaagttcccgcatggttttttccacccaaatgtctattcttcanggacg

SEQ ID NO: 6637 - DNA, 372 bp, Triticum aestivum
  Clone ID: LIB3281-042-P1-K1-D7
agctcgtccacaagatcgtgtctggtggctttgactgtgtcgtcaaggtgtgggagtttgtcaatggtggctggaagctggagagcgctctggtctccgacatgcacaaagagtgcgtgagagatgtctcatgggcaccggtcctgggcctggcaaagtcaaccatcgccagtgcgtcccaagacggcaaggttgccatctggaccagtggcaaaggaggaggcaagtgggaaggaaagctcatgcgcgacttcgcggccccggtgtggagggtgtcctggtccctgacgggaaacatactgtccgtggctgccggcgagggcgacattactcttgggaaggaatcgtcggacggtcagtgggagtcgctgt

SEQ ID NO: 6638 - DNA, 337 bp, Triticum aestivum
  Clone ID: LIB3281-042-P1-K1-D8
gtgtccattcgctttgctacgtagcagcagcagggtagctcctcagtccaatacgtcgtctcgagtgaagaagatcagcagctcgatggcgctctctcgtcgcagcgccgcatccgccctcctgcttctcgtgctcctcgtggccacagagatggggacgacgacgaccaagctggcggaggcgcgggactgcctgtcgcagagtcacaacttcaagggcgcctgcctcagcagcagcaactgcgccggcgtctgccacaccgagagcttccccggcggcgagtgccacacgcagcacttcgagcgcaagtgcttttgcaagagggtctgctagccc

SEQ ID NO: 6639 - DNA, 382 bp, Triticum aestivum
  Clone ID: LIB3281-042-P1-K1-D9
cccacgcgtccgcggacgcgtggggaggagctgatttctccgagcgggcagtggcaaactggcaatggcgtgctacgccgctctcctgcaccagccgcccgcctcgccgtccccgtgcacctcaggccgcgtcggctcctgccgtgtccgtccgcccccactcctccagcgccgagcccctcccctgtctgtgcgcgctcggatctccccccgctgctcctacgccgcaaccggagaaagcgccggagcgggcgccggagaacagcccgcggcggcgctccggagagtgctggggacgccgggcgcccaccaagcgcccgcttgctacgactcgctcagtggccggctcgtctagcgcgcccggttcaaggcctgcttaacg

SEQ ID NO: 6640 - DNA, 307 bp, Triticum aestivum
  unsure (1)...(307): unsure at all n locations
  Clone ID: LIB3281-042-P1-K1-E1
tctactctaccccagaggggccccgagcgtgtgctgcgccgtgtgccatgccgtcaccaacgctccccctncaggaatggagatggctcagcttatatgcgtcggctgtcgaactttattgatgtatactcgcaatgcaactactgtcagatgctcatgttgtgatacagtcaaccttgccagaccagcaccgccagtgaatagtatagctcatgtgaactgtggccagtgccagacggtgttaatgtatccatacggagcatcttctgtcaaatgtgctatctgcaattttattacaaacattgga

SEQ ID NO: 6641 - DNA, 326 bp, Triticum aestivum
  Clone ID: LIB3281-042-P1-K1-E10
gctcccttgcagaaccttgcggcgacgattctccaaaggaggttgggcgccggcgccgcagacctcggcgtggtagtgaccccgcgcacctgcccccgaccggcgtccccccgatgtggcggctgcccgggctgctctcccaggccgccgcggccgggagggcggcggcgaggaccagcagcggccacgtcaggggttccaaggggttctccagcggaggggacggttccccgctgccccgggggtggctgcgaaggctgtggatcgaggagctgaaaagggagaaggaagctgcgaggagactggggggaggcgccttggtctgc

SEQ ID NO: 6642 - DNA, 334 bp, Triticum aestivum
  Clone ID: LIB3281-042-P1-K1-E11
agttggagtaccttgaggagcgtcgccttaaggatctggtgaagaagcactctgagttcatcagctatcccatctctctctggacggagaagaccactgagaaggaaatttctgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcacaaaggatgagtatgctgccttctacaagagcctgacaaacgactggga

SEQ ID NO: 6643 - DNA, 351 bp, Triticum aestivum
  Clone ID: LIB3281-042-P1-K1-E12
cccacgcgtccgctaaggttcaacctgcgaaaaagaaataggaatatgaataatctaaccgaacctcgctataataacctatcatatcatattccaaagatgccatatgacagtgccagccactgaggatgctcaaccacctgcttaagaaccctgttgaatccattgtattgcagttctatcctaatatacaagaccgctaattgcagaaatgaaactacagcttcagttaccagatcagacacaacttataacatgacctgcactcactgttacgctatagttgcagtctataccaaaggaataaacacgaatgaagattagaagcttcacctaacgaaatcaaaaccg

SEQ ID NO: 6644 - DNA, 212 bp, Triticum aestivum
  Clone ID: LIB3281-042-P1-K1-E3
cggacgcgtgggcgtgatcacacactatggatgcatcgaccagatcacctgttcgccaggcgtctacctttcttattcaagtaaggctgcaattggtgactgtcttgacacggccatggttctcttggcctacacagaaaacatgagtgatccgacgttccaaagctagaacaatattatcctcatgagcagaactgacgatgctgtataca

SEQ ID NO: 6645 - DNA, 263 bp, Triticum aestivum
  Clone ID: LIB3281-042-P1-K1-E4
ccaaaaaacaggcgcgccggcgccgcagacctcggcgtggtagtgaacccgcggacctacactccaagacgcgcgacaacacgatgtggcggctgcccgggctgctctcccaagccgccgcggccgggagggcggcagcgaggaccaccagctgccacgtaacgggttccaaggggttcttcagctgttgtaaaaggtccacgatagcgcggaggcagctgaaaacgctacggatcgaggagctgaaaagggagaaggaagct

SEQ ID NO: 6646 - DNA, 353 bp, Triticum aestivum
  Clone ID: LIB3281-042-P1-K1-E5
gggaaatgcaaccaaggctccatacaggaaacctgtgtataagcaggtggcagctcttcattcaagtgtgttgatccagaaggcccgcccctcgaactcggagggtggtggctccttgtcgaacccgtctgccggttcggcgtcagctaaaccgaaacggaagctgccaccaaaggaaggttctgatgaagtctcgtctcgtctttcgggacttggtgcccggagcagtagtaatcctaaggagaggcctgggcagttacaacctcgggccaacaagaggttctccttgcctggcactggcacagaagttggcaaacggcaagtgaataaacctgcggtgaaccgatccccca

SEQ ID NO: 6647 - DNA, 384 bp, Triticum aestivum
  Clone ID: LIB3281-042-P1-K1-E6
cccacgcgtccgaccgaatcagaaatctcaagctcagcacagcaacaatggccgcgcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcctcgccactggacgcaagatcattggcgccaccaaccccctggcctgtgagccccgcaccatccgtggtgacttttccgtcgacatcagcagga

SEQ ID NO: 6648 - DNA, 349 bp, Triticum aestivum
  Clone ID: LIB3281-042-P1-K1-E7
caggagcgttctactctaccccagaggggccccgagcgtgtgctgcgccgtgtgccatgccgtcaccaacgctcgccctccaggaatggagatggctcaccttatatgcgtgggctgtcgaactttattgatgtatactcgcaatgcaactactgtcagatgctcatgttgtgatacagtcaaccttgccagaccagcaccgccagtgaatagtctagctcatgtgaaccgtggccagagccagacggtgttaatgtatccatacggagcatcttctgacaaatgtgctatctgcaattttattacaaacattggaatgaaccccgggagacctttgccacctacaatg

SEQ ID NO: 6649 - DNA, 231 bp, Triticum aestivum
  Clone ID: LIB3281-042-P1-K1-E8
acgactcctggtcttgatcacgcactgtggatgtagaggatcagatacttagttcgccaggcatgctactattcttatactgtttaggctgcagttaatgccattcttcagacggtcatggacctcttcgcctacgcagaatacatgtctgaccgcaacttccaaagctagaacaatattatcctcatgagcagtaccgacgcttctataaacaggactcctagggccaag

SEQ ID NO: 6650 - DNA, 134 bp, Triticum aestivum
  Clone ID: LIB3281-042-P1-K1-E9
cggacgcgtgggtgtgatcacagactatgaaggcatcgactcagatcacctgttcgccaggcgtcaaccattcttactcagttaaggctgcaattggtgcctctcttgagatggtcatggttcctttcgcctac

SEQ ID NO: 6651 - DNA, 293 bp, Triticum aestivum
  Clone ID: LIB3281-042-P1-K1-F10
cttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacct

SEQ ID NO: 6652 - DNA, 379 bp, Triticum aestivum
  Clone ID: LIB3281-042-P1-K1-F11
cccacgcgtccgaacgcggtgtacatggcgatcctggtggagtacgagaacggcgacggcgacgtggtgcaggtggacctcatggagtcgggccgccggggacgcggcgggcggtggacgcggatgcgcgagtcgtggggctccatctggcgcctcgactccaaccaccgcctccaggcgcccttctccctccgcatccgcaacgagtccggcaagaccctcgtcgcccgcaacgtcatccccaagaactggaggcccaacaccttctaccgctccatcgtccagtacagctagacctcttcctccgtcgacgggtcgcggcacagctctgttttggcgggagttgatgctgttttggcgggagttttcaattaatttc

SEQ ID NO: 6653 - DNA, 369 bp, Triticum aestivum
  Clone ID: LIB3281-042-P1-K1-F12
gccacgcgggcgaagcagcttggaatgctgaacttatgagagagatgatgcggaacacagacagagccatgagcaacattgaattttctgcagaaaggtttaatatgctgcgccgcatgtatgaaactgttcaaaagccatttatgaatgccacagcaatggctggggagggcgacacaactccaaacatcatttgcagctcttctaggagaccaggggtctaaccaagccagagatccaactggagatgcacaaactactgttcctgctgcaaataccaatccactcccaatttactggggcgcaaatgctggggctgcacaaggagcagcaaggccctttgctgctgcaaggagtgccacaagcggt

SEQ ID NO: 6654 - DNA, 52 bp, Triticum aestivum
  Clone ID: LIB3281-042-P1-K1-F2
tcgcggacgcgtgggttttgaacgcatctaaatggtctttaacaaaacattt

SEQ ID NO: 6655 - DNA, 227 bp, Triticum aestivum
  Clone ID: LIB3281-042-P1-K1-F3
cgtgtatggctgcaagttgtgcattgtaccttccactacatgaggagagtgttgtttcttcaactcactctccacggactgttcgatcactgattcacaatctcgcctgatccaccagcaaacgttcatgcctattgctggaaaggagcccctcaagcacatataccatttgaccgaataacaactgaacggaggcggcttaataaggattaaacaggggaagagca

SEQ ID NO: 6656 - DNA, 104 bp, Triticum aestivum
  Clone ID: LIB3281-042-P1-K1-F4
cttctgcgtcccattaatgtaaagctgagaacaccggttcgggtcgttagggtctatatgaggcgcactagaagaacgcctcattgggtgctcttaccgctgct

SEQ ID NO: 6657 - DNA, 382 bp, Triticum aestivum
  unsure (1)...(382): unsure at all n locations
  Clone ID: LIB3281-042-P1-K1-F5
cggacgcgtgggcggacgcgtggggtcggcagcaaggatgccgccatttgctccggttcaagtgcagccatgctctagagagcagacagatgtgaaggagtataatctgttttccaccgatcaaagcggctatttccctttatcccgttaaaagcaacacacatgggggacgtgctcttctcatttttactgtctacaactgtatacggtgagtgattgtatcaaccgaacgaaataaaggatgttttgagtggtttttctgtatgcttacgtgccttcagttttggactatagggccgggaactatatctttatacatttttttcttatantttccctttgtgtgtatgagaagatagtgtatcatgtagcctttttgatt

SEQ ID NO: 6658 - DNA, 361 bp, Triticum aestivum
  Clone ID: LIB3281-042-P1-K1-F6
cccacgcgtccgggcgacggcggcacggcggcggcctggatggcgacgcaccgcgggatgtacgagcgggccacgcggcaccccttcaccgtctcgatccgcgacggttccgtcgacctggccgccttcaaacgctggctcggtcaggactacatgttcgtgcgggaatttgttgcatttctagctagtgtattgctcaagtgttgcaaagagtcagacagctcggacatggaaacaatcctaggtggcttggcttctcttagtgatgagctctcttggttcaagaaggaagctgctaagtggagtgttgatctggccggtatttctcccctcagttctaatatggagtactgcaggtttc

SEQ ID NO: 6659 - DNA, 208 bp, Triticum aestivum
  Clone ID: LIB3281-042-P1-K1-F7
cgcgacgcgtttgtgcagctgtatctacagctttaacaaacactagaggcggggaggtaggaatcaaataggaatagcagtgtgcaaagatttgtggagagggttgagcttctgcagaagcagacaattattcattaccagccaaataaatctcactccctcctcaagaaagaaagtgcccgccctacaaacgttggttgctggcggg

SEQ ID NO: 6660 - DNA, 314 bp, Triticum aestivum
  Clone ID: LIB3281-042-P1-K1-F9
gttcctctggttttttgacgactaatatcattatgaaaaaacaattaagtatggggctatgtatatacggctgctaaactcgttgtattaattgcacgcttggctggtgaagttaaccgactattttcttcattagcaattgtgattttaggccctacttgttaaaacaaatatgcactatctaagctacaaaaatgtttaccccaattgctgtgcacttcttttattgcggggatatattagtctaatgtttgctaatgtttgtgtgttgccagacttgataccatatatgctctgttttttctgggttgcta

SEQ ID NO: 6661 - DNA, 169 bp, Triticum aestivum
  Clone ID: LIB3281-042-P1-K1-G1
cggacgcgtgggcttccccttcccggagcagcagccagagaggaagcgagagagagagagagagagggcgatggatgggaaggaggaggacgtgcggctgggcgccaacaggtactcggagcggctgcccatcgggacggcggtgcttggcggctgcgactacaaggac

SEQ ID NO: 6662 - DNA, 363 bp, Triticum aestivum
  Clone ID: LIB3281-042-P1-K1-G10
cggacgcgtgggcggacgcgtgggcggacgcgtgggtttgaaactagtgccaagacaaacctcaacgtggagcaagttttcttctccattgcccgcgacattaagcagaggcttgccgagaccgattccaagcctgaggacaagacaatcaagattaacaaggcagaaggcggcgacgccccggcagcttcggggtctgcctgctgtggctcttaagggacgagtcagtgtgtccgtgatcattgtttatttgacatcattcggttcctgctgctgcttgtctgttataggaagaatgtcaatcaagaagaaaattatgacttatgatacagatctgggtgtacttatattcgcttcccattc

SEQ ID NO: 6663 - DNA, 380 bp, Triticum aestivum
  Clone ID: LIB3281-042-P1-K1-G11
ggacagatatgagacaacatacttcaaaccattctctggctattatttctctggtgatggttgtaggagggacaaagatggttaccattggctgacaggaagagtggatgatgttatcaatgtcagtgggcatcggattggtacagcagaggttgaatctgctcttgtttcacatccaaaatgtgccgaggccgctgttgtcggaattgaccatgaggttaaaggtcagggaatctacgcatttgtaactttggtggatggtgttccttacagtgatgatctacgaaaaagcctcattatggcggtccgcagccagattggcgcgtttgcatcacctgacaagatccactgtgcaccggggctccccgaagacacggagc

SEQ ID NO: 6664 - DNA, 327 bp, Triticum aestivum
  Clone ID: LIB3281-042-P1-K1-G12
cccacgcgtccgcggacgcgtgggttggcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtatgacgaggcgatgcgccaggcgatcgatgccatgaacggtcaggacct

SEQ ID NO: 6665 - DNA, 381 bp, Triticum aestivum
  Clone ID: LIB3281-042-P1-K1-G2
cttttgttgacacgaggttcactttgcaccagacaccgtgtgcaaggttgtcctcaggtgagttggatgctctagaaagctcaggtttgacgtcaatgcatgctactgataattctcattcacgctttcttcatggattccctaatggatctcaaacagcgaattcagatcgtggatctcatgtagagaaaatgaactcagggcgtgtctctacagattatggaacagctggctgtgtgcatggtaatgataaagttgctcctggaccccatatactgttgcctattgacccttttgaagcttttgcgccacaaagatcagtagcaaatggagcatcccctgtgtatcaaaatgaaaattacgaccagtttttggtgcaca

SEQ ID NO: 6666 - DNA, 195 bp, Triticum aestivum
  Clone ID: LIB3281-042-P1-K1-G3
aaggcagtcgacaacttttttccttcatccccctcctaatcgaacttgtttcgggacggcggcggcgctgcctataaactgtttcggcggtatgtttacccatggcgcaagctaaacaggggcgtacccggagcttcggtgtggaccgctccaaaactggctctggagttttatgatatcatgagcgtggtgaat

SEQ ID NO: 6667 - DNA, 193 bp, Triticum aestivum
  Clone ID: LIB3281-042-P1-K1-G4
cccacgcgtccgggcgcacgatacacgttgttaccctatataatagaacacgctggggtgagcaagcccgcgcgccggacttatgctagcgcaatcgtaccggaggccaaaggatgcgccatgcattgtttatcattcatccggcacgactacattactgagcatgatacatctgaatgaaaacgcagactgt

SEQ ID NO: 6668 - DNA, 303 bp, Triticum aestivum
  Clone ID: LIB3281-042-P1-K1-G5
cacgcaagccccatcccaccaagctcagatcgaccatcacaccgtgcacggtgctgatcctgctcgcggggaggtacattgaaaagcgcgtgctgttcctcaagcagctcaagtccggccttatccacatcactggacctcgcaagagcacaggcgtagcgcaatcaccagattgagccaagcttacaacattgccacatccacaaaggtcgacatctgtacatgaaatgagcagaagtgggatgacaagatctttgctagggagaaaaagactagggcacagaagactgaaggcgaactatt

SEQ ID NO: 6669 - DNA, 353 bp, Triticum aestivum
  Clone ID: LIB3281-042-P1-K1-G6
ggaggaagcagcggagtcagccatggggagggggagggtggagctgaagcggatcgagaacaagatcaaccgccaggtcacctttgccaagcgcaggaacggcctgctcaagaaggcctacgagctctccgtgctatgcgacgccgaggtcgcgctcatcgtcttctccaaccgcggcaagctctacgagttctgcagcacccagagcatgacgaagacactcgacaagtatcaaaaatgcagttatgcaggacctgaaactactgtgcagaacagagaaaatgagcaactgaaaaacagtcgcaatgagtacctgaaactaaaggcacgggttgataatttacagcgaacac

SEQ ID NO: 6670 - DNA, 171 bp, Triticum aestivum
  Clone ID: LIB3281-042-P1-K1-G7
cttaagagggggtgtaagcttctcacccaacatatataacggtggcctgacggataaaacgaggtggcaatatctcttgctggagatcacaaggttaggaacgatacttgtaatctcacggtctttgttgatggtccggtgaagggagagcaggcaaagaagaaaacgaag

SEQ ID NO: 6671 - DNA, 356 bp, Triticum aestivum
  Clone ID: LIB3281-042-P1-K1-G8
gccgagcgcgccggcgggcgcgggcgcgctggtcaagctcgggctgctgggaggcgcggcgctctacctcggcaacaagaccctctacaacgtcgagggaggccaccgggccatcgtcttcaaccgcctcgaggggatcaaggacaaggtctaccccgaggggactcacatcgtcatcccctggttcgagaggcccatcatctacgacgtccgcgcgcgacccaacctcgtcgagagcacctccgggagccgggatctccagatggtgagaattggtcttcgtgttctgacacgacctatgccagagagactaccaactatgtacaggaccctgggggagaactataatgagagag

SEQ ID NO: 6672 - DNA, 120 bp, Triticum aestivum
  Clone ID: LIB3281-042-P1-K1-G9
ccggggttgggggctcgacccacgcgtgcggccgagcgggcgggcaggctccttcgctctattcaagctctgtctggtgggaggcgcacccctatacctctgtttcaatacgcgtataca

SEQ ID NO: 6673 - DNA, 298 bp, Triticum aestivum
  unsure (1)...(298): unsure at all n locations
  Clone ID: LIB3281-042-P1-K1-H1
ctgacgcgtgggcggacgcgtgggcgcatctcgagtagtttccagttcgccggagaaggagcaagatggccggaaggaagggcggctacaggaagaaggcggtgacccgctccgtaaaggccgggctccagttccccgtcggccgcatcggtcgctacctcaagaagggccgctacgcccagcgcgtntgcttcggcgcccccgtctacctagccgtcgtactcgagtacctcgccgtcgaagttcttgagcttgcatgcaacgctggccaggtcaacaagaagacgcgcattattcc

SEQ ID NO: 6674 - DNA, 376 bp, Triticum aestivum
  Clone ID: LIB3281-042-P1-K1-H10
acccctcctccatccctccctccctccccccatccatccatccgcagtaaagccttcgctgcgctagatctcgccgcccgccccgatttcttttctcggcctctcccagtagctcgctcggcagatctgcgcctcctgggaatctccgtcgcttccgtccaaaggctcgattcttttcttgctcttcgctgaggctttccccggatcgcacggtcgggggacacacaggatgatgggtcctgcgtggtgggctgtgctgctgctgctggccatggcggacgccgtggcggagaggttcgtggtggagaagaacagcgtgcaggtgacctcgccggagagcctcaagggcaagtacgagtgcgccatcggcaacttc

SEQ ID NO: 6675 - DNA, 365 bp, Triticum aestivum
  Clone ID: LIB3281-042-P1-K1-H11
cgcagaggaggagagagagagggtagcagcagaggaggagagaggagggctgagtccacgtgagcccagcggaggaggcggaggaggagcgagagatccccctctccctccctctctccggccatggatcctccctacgcaggagctattattgaacctgctaaatgccgattgatgagtgtggatgaaaagaaggatcttgttcgtgaattgtcgaagaggccacaaactgctcctgacaaactacagtcatggagtcggcgtgatattgaggagattctctgtgctgatctcggaagggaaaggaaatatactggattatctaagcagagaatgctggattatctcttcagggtggtgactgg

SEQ ID NO: 6676 - DNA, 328 bp, Triticum aestivum
  Clone ID: LIB3281-042-P1-K1-H12
cggacgcgtgggcgaatccacctctcgccggagtcccagcaaggagcgagcaagccaggaagatggacgccagcaagctgaagaaggtggccgggaagaagttcggcgggccgaggaagaagtctgtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccggcgaggtgctggagctggccgggaacgccgtcaaggacaacaagaagacccgcatcgtgcccaggca

SEQ ID NO: 6677 - DNA, 376 bp, Triticum aestivum
  Clone ID: LIB3281-042-P1-K1-H3
cccacgcgtccggggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcactccacacgttcacgatccacgggctgtggccggactacgatgacgggacctggccgtcgtgctgccggcacaccagctttgacatggacaagct

SEQ ID NO: 6678 - DNA, 298 bp, Triticum aestivum
  Clone ID: LIB3281-042-P1-K1-H4
aacgtacgagcgctcctccgtcctgaacctggccggcgcatctccgacgacatggcccgcaccaagcagacggcgaggaagtccaccggcggcaaggcgccgaggaagcagctggccaccaaggccgtccgcaagtccgccccggccaccggcggcgtaaagaagccccaccgcttccgcccctgcacctgtgcgctccgggagatccgcaagtaccagaagagtaccgagctgatcatccgcaagctccccttccagcgcctggtgagggagatcgcccaggacttcaagaccgacc

SEQ ID NO: 6679 - DNA, 325 bp, Triticum aestivum
  Clone ID: LIB3281-042-P1-K1-H5
gccttgtcagggagaggccatacttgcttgatgaggatcttggagatggctctgaagataagcaggggctgtacacgtggcaagacctatgtgtgcttgttcagtccagcgacagcgagctgctggaggggctgtattccctatcggctgtctagattgatgggttctggaggaccgcggatgtcggttctgtgaacacggttctggacatgattctgcacaactctgtgtagcatgattggctgctaaatgctttgccagaaaatgctgtgctatctgccatggaagccgacggttttacgcataagattgtaactcattggct

SEQ ID NO: 6680 - DNA, 331 bp, Triticum aestivum
  Clone ID: LIB3281-042-P1-K1-H7
gtcccggccgggggaagaggccatggagatattctactaccttgtgttcgggggcctgtcggcggtggtggccgggctggagctgggcaagagcggcaaggaccgcgtctcaacccccaccgcattcaacgcattcaagaacaactacgtcctagtatactccctaatgatgtccggcgactggcttcagggtccctacgtgtactacctctacagccagtacgggttcgacaagggcgacatcggccgcctctttatcggcggattcggctcattcatgctctttggaaccatcgtttgatcactagcaaacaaacaggggccgcaagcg

SEQ ID NO: 6681 - DNA, 96 bp, Triticum aestivum
  Clone ID: LIB3281-042-P1-K1-H8
ccgacgcgtgcgcgcacgcgttcgctcatcattacttgacatcaatactggacctaaacttctggtccaagaggatcatagccaacgtgtatatgg

SEQ ID NO: 6682 - DNA, 335 bp, Triticum aestivum
  Clone ID: LIB3281-042-P1-K1-H9
gcaccacgcccgacggggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgcttcttcacccgccactgctgcgccgtcaacggctgctgccggtcggaggcactccacacgttcacgatccacgggctgtggccggactacgatgacgggacc

SEQ ID NO: 6683 - DNA, 114 bp, Triticum aestivum
  Clone ID: LIB3281-043-P1-K1-A1
cggacgcgtgggcatagtgttcgttagatagagccatattcttgtggaggggtgcgacgaactacatcggcatgcacgtcttcctggctagtgcgcggctcgtccaccctacct

SEQ ID NO: 6684 - DNA, 383 bp, Triticum aestivum
  Clone ID: LIB3281-043-P1-K1-A10
cccacgcgtccggagctcccaaactcagatgcctggggaatcaaggaaatatggtacaactattgctcctagtctgtatgcacctgtccaccagcatttctttgttgcccgtatggacatggctattgattgcaaacctaacgaagctcataatcaggtggttgaagtaaatgtcaaagtcgaaagtgcaggcacaaataatgtgcacaacaatgctttctatgctgaagaaaagatactgaaatccgagttgcaagcaatgagagattgtgacccttcatctgcgcgacattggattgttaggaacacgagggctgtaaatcgtaccggacaaccaactggtttcagactcgtgcctggttcaaactgtttgccatttgctc

SEQ ID NO: 6685 - DNA, 385 bp, Triticum aestivum
  Clone ID: LIB3281-043-P1-K1-A11
tgaaagtgctatccaaatacgaagagatgaagaagcctatggcgtcggcacgtacagaacagccagtggtcataccaattgccacggagcatgaagattctgtgactgttggcaatgaggatgccctggtcagaaaaccagctgctgctcgagcaatgtcaggcggcgatgatgatatcctcgatgatcttgacgagatgatatttggcaagaaggggggcagtagttcccaggatccaaaaggcaggacccaaagaaggatgacctaatcaacttctaaataccgtcccagcaagttgcggagttcctctagggatacacagcatgtctgctgctttttatactgctgaacgatgtctgtattcatccggtagaagactgcact

SEQ ID NO: 6686 - DNA, 386 bp, Triticum aestivum
  Clone ID: LIB3281-043-P1-K1-A12
agaccggcgtcttcgtactcgcctctctcgcgcgcttccgagctttggcctgcgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttt

SEQ ID NO: 6687 - DNA, 394 bp, Triticum aestivum
  Clone ID: LIB3281-043-P1-K1-A2
gaagcatcgggcatcccgcgcgcgggcctgtggctcacgttcggcctcgcgatcttctggacgatgccgttcccgtcgtgggaagcgctgatcaacatcgtgtcggccgcgctggtgctgagttacgcggtcgcgccggtatcggtcgccgcgctgcgccgcaccgcgcccgacctgccgcggccgttccgcgcaatcgcgttcggcatcaccggccccgcatcgttcgtgatcgccgcgctgatcgtctactggtcgggctggagcacggtgtcctggctgctcgggctgcagatcgtgatgttcgtcatctatctcgcgtgccgccgctgggtgccgaccgcgcacctgagcctcgccgaacaggtgcgctcgtccgcgtggctgatcgcgt

SEQ ID NO: 6688 - DNA, 384 bp, Triticum aestivum
  Clone ID: LIB3281-043-P1-K1-A3
gcgtgctcgccggtcgctggcgccacgcgtggagatccatccgtcgcctgcacctcagccccgaggactggtgggacagaggcagccccgaacatctgaagaatttcttcgacgctctgctatcccccggcggccatgactcgattctggaggaggcccagctggacttcgatggattggtcgaagattgcgcgcacgccgaagtctggatccgacgaattttgtcgggccaagctcaggtgctcgatgtctccttcgccacactggaaaaccctcctctggtctcccgacacctgagaaaactggagctcactgaaatgattttagaaggagatgttcttgatttcgcgagctgcccagcattggaggatcttaagatggcag

SEQ ID NO: 6689 - DNA, 328 bp, Triticum aestivum
  Clone ID: LIB3281-043-P1-K1-A4
ggctgcaggtgccagggtgtgcccccccatcctgatccatgactgggccgggagtcctccgcggtgcatgatcgccccaatgcaggatttgatcgttcactacagggacaaggcttttgatggcacctgcatgcttgaccactacaggatctgatatcgatccatcaaaggctacttgatagaataaatgctgtgatcacagcacagtagattagctgcaagcctgcaaggccatctactttgcgttgcatgcttccgtagaatatgaaacaagtctatgcatgtatgcttacaacattgagatcttttactaaaaaaattgatgccc

SEQ ID NO: 6690 - DNA, 382 bp, Triticum aestivum
  Clone ID: LIB3281-043-P1-K1-A5
cggacgcgtgggcggacgcgtggggcgaagattggaatctccgtggcaaaggccatccacgccggggccctcaagctcacactagggggtgtggtgcttggggatagctggatctcaccagatgattttgcgctgtcatatgcgcaactgttgcatgatgtatcgaggctgagcgacgaagctgttgcccctctcaacagaatggcggcaattgtaaaagagcagatagcagccggacaattcaccacggcgaagatgacgtggacgaatcttgttgatttgattgaccagcagagtgatggcgtggatatgctaaatttcttgcttgacaaaggcgaaggctcatcgacgagccaggtgtttccgtcgacccccaacacca

SEQ ID NO: 6691 - DNA, 381 bp, Triticum aestivum
  Clone ID: LIB3281-043-P1-K1-A6
cggacgcgtgggcgcttgaagaaggacggtgcatgcatacttttgtgctccgtcatgggtacgagcaccacatccatgtgcggagctcagtggtggatatgtatgccaagtgtggtgccattgatgcagcccaaaggctcttcaacgtggcaccagtgaaggacgtaataatgtcgacctcaattttgtcaggactggcttcttgtgggaggattggtgatgcaaagcgagtgttcgacaggatgcaagagcgtaacttagtgtcctggaatgctatgttgactggttatatcaggtcctcggatctgactggtgctttgcatttgttccagcagatgaggaaggagacaaaggagcttgatgatgttacacttggttcgg

SEQ ID NO: 6692 - DNA, 255 bp, Triticum aestivum
  Clone ID: LIB3281-043-P1-K1-A9
cccacgcgtccgggagcatgagggttctaagactgtttgctctcgccggggcggggctgatgttggacgtgatcaattcagggacagcgacagtgtcatacatgataagtcagcagtacacatgctacttcatgctgagggacggccaccacagctactggggatatagccgctgcctggattgcctcttctacacctacgactgattcatggaggcctgcagcacgttacgcgcatttggcactagtggctaac

SEQ ID NO: 6693 - DNA, 388 bp, Triticum aestivum
  Clone ID: LIB3281-043-P1-K1-B1
tcgtgctcaactttctgaaagcccataactacaagggcacgacaatgatgttgaacgacagaattcagagccttcgtggtctccagtcagcccttaggaaggcagaagaatatctagttagcattcctgaagacacccccagctctgaattcaaccacaggttccaagagcttggcttggagaagggttggggtgacaccgcaaagcgggtacacgacaccatccatttgcttctggaccttcttgaggcccctgatcctgccagcttggagaagttccttggaactattccgatgatgttcaatgttgtcatcctgtcaccgcatggatactttgctcaatccaatgtgttgggataccctgataccggtggccaggttgtgtacat

SEQ ID NO: 6694 - DNA, 375 bp, Triticum aestivum
  Clone ID: LIB3281-043-P1-K1-B10
gcggatccagagagtgctagggttttctctctctcccggcggcgagggcgatgtcgatggcggcggcggcgagggcggcgactagggccccgggcagggcggcggcgcggttcgtgcaggccaggctccgctcctccggcaaggtgctcagcgaggaggagcgggccgccgagaacgtctacatcaagaaaatggagcaagagaagcgggagaagcttgcacgcaagggtcccagcactggagagcaagctccgtccaccccaagcgctgcagcaggcgacgtgaacactggaggcgccgcttcgaccgtgtcggcgtccgcagcaggcacgtcaaccgacaagaacaggaactacgccgtgctggctggcaccc

SEQ ID NO: 6695 - DNA, 378 bp, Triticum aestivum
  Clone ID: LIB3281-043-P1-K1-B11
cggggaccgacgcgtccggcggatccagatagtcctagggttttctctctctcccggcggcgagggcgggggcgatggcggcggcggctagggcggcgacgagggccccgggcagggcggcggcgcggttcgtgcaggccaggctccgctcctccggcaaggtgctcagcgaggaggagcgggccgccgagaacgtctacatcaagaaactggagcaagagaagcgggagatgcttgcacgcaagagtcccagcactggagagcaagctccgtccaccctaagcgctgcatcatgcgacattgaacactggaggcgccgtttcgaccagttcggtgtccgcatcaggcacgtcaaccgactagtacaggatctacgcc

SEQ ID NO: 6696 - DNA, 312 bp, Triticum aestivum
  Clone ID: LIB3281-043-P1-K1-B12
cggacgcgtggggccgtcacctacaccgagcacgcccgccgcaagaccgtgaccgccatggacgtcgtctacgcgctcaagcgccagggccgcaccctctacggcttcggcggctaggccgagggcccagccgtccagctcgccacgccgccgtccgaccgagagtagtagtggtatctatctagttgctgtctagggttcgaggctctccgtgtatgcgcagtgtttcgctggtgtgtgtctgctcccgtcttgtgagctggtgttgtactggaagaaatctggaatggaaattgcagtagcttatccctg

SEQ ID NO: 6697 - DNA, 385 bp, Triticum aestivum
  Clone ID: LIB3281-043-P1-K1-B2
agtaccacccccacccaccccacctcctccctcctctgctcctgctcgcggggcagagcggctaggcagccatggcgcgagcctcgagcctgtcgctgctgctcgcgctggtggtcgcggcggcgacgtcggcggcgggggccagggtgcccgtggacgcggccgggaacgcgacgctgagcgagctccgcgcgcggcgggggcggcgggaggcgctcgagaacggcctcggcaggacgccgcagatggggtggaacagctggaaccacttctactgcgggatcagcgaggagatcatcagggagacagctgatgcattgatcaacaccggtctggcccgattgggctataaatatgttaacatcgatgattgctgggcagaatt

SEQ ID NO: 6698 - DNA, 100 bp, Triticum aestivum
  Clone ID: LIB3281-043-P1-K1-B3
cccacgcgtccgtccacgcgtccggcagagcggtcgttcgttatctagagggggcctacgcgtgcggttgtggatcgctagcggtcgctcgttgggcgcg

SEQ ID NO: 6699 - DNA, 377 bp, Triticum aestivum
  Clone ID: LIB3281-043-P1-K1-B5
cggacgcgtgggcggacgcgtggggaatcaggtagaggcttatgaagggagtaagaaacatatggattgtagtcctgcaaaattacctgaagaaaacgagctgcttaagaaatacttggcaactatcaacccagaacacattgatactgtgctgatagaacgcttgcttagaaaaatatgtactgactccaatgaaggagctatcttagtcttccttcctggttgggaagatataaatcaaacacgggagaggttacttgcttcttcctttcgggattcttcaaaatttcttgtactgtcacttcattccatgatcccatcttcagagcaaaaaaaggttttcaaacgtgcaccggcaggggtttgtaaaattattc

SEQ ID NO: 6700 - DNA, 371 bp, Triticum aestivum
  Clone ID: LIB3281-043-P1-K1-B6
cttcttctcgcttccttttcctgcttcaacaagtgataaataagaacgggggcagcatcatcatcatcagcattagtagccaagcagtagtaatttcggtgccaagatgtcgtcgtcgtcgctgtcgccgggaggcgggaggctgtcgggctcggacggcgactcgggggcgacgttcgcggccggggacaaccggcgggagaagaggcggctgtcgaaccgggagtcggcgcggcggtcgcggctgcggaagcagcagcacctggacgagctggtgcaggaggtggcgcgccttaaggccgagaacgcgcgcgtgctggcgcgcgccaacgacatcaccggccagttcgtgcgcgtggaccaggagaaca

SEQ ID NO: 6701 - DNA, 387 bp, Triticum aestivum
  Clone ID: LIB3281-043-P1-K1-B7
gttggcgggctcactggatttcattcgtatctcattagcactaaccagacgacatacgagaattttcggtacagagcagacagcaggcccaacgtctatgaccgaggatgtctgaataacttcctagaagtcctgtgcagcaaggggaagccttctaagcacaggttccgagcctatgttcaagaggaggtacgcgctccagtagttaacttcggtaggcagatggaggaggaaccggctggcggccctcgcgcaaaggtagaagacgatcttgagattggcagcgatctcctgaagatctctcggcggcgcaactatgaggacgttgacgtcgaaatggggaaccaggacgacggtgagacggaaggcaccggcggccccaaactg

SEQ ID NO: 6702 - DNA, 387 bp, Triticum aestivum
  Clone ID: LIB3281-043-P1-K1-B8
cggacgcgtgggcgactgcttgccctaccccaccacaggcggtacgcggtgggtggggaaggcgcggccgtgcgaggcggacgcggcgtgcgtggcgcagctgcgcgcgtgcggcgccgttctcgccggcaagaccaacatgcacgagctcggcgccggcaccagcggcatcaacccacaccacggatcggcgaggaacccgtacaacgtcggcaaggtggctgggggctcctccagcggctcggccgccgtggtctgtgctggcctctgccccgtcgcgctcggcgtcgacggaggaggctctgtccggatgccggcagcactgtgtggcgtggtcggctttaagcccaccgtcggacgcctctccaacgccggagttcttccact

SEQ ID NO: 6703 - DNA, 381 bp, Triticum aestivum
  Clone ID: LIB3281-043-P1-K1-B9
cccacgcgtgcgcagacacgtggggcctaataatgtgttcgcatacactgatgtgcctgaagtagcacctaatcaatttgccatacccagagttccatacatggaatccagaacttcgcaggacttggttaggggtgagcctgaaaggtcaactcctggggatatattccctggcttcaatgtctctcctggtgtcctggctgagccatcatttgctgcaccacttgcaccccaactggccatggtgtctcatgctggaaaatcaacaaatacgtttgacatggcatttgagtctgatgttgaagccatcgacatgtttatggatttgacctcactacaagcaacattgccggatactcatcttcccacaaaatacatcat

SEQ ID NO: 6704 - DNA, 365 bp, Triticum aestivum
  Clone ID: LIB3281-043-P1-K1-C1
ctctagatctcccggcgcaacaaacgcaaggccaccggcgcctccgcgcaggcgcagtcgccgtctctgcgatcttgcccgccgccgccgccgctgccgccccgagagatggcaaaggcattttacgcggtggggttctggatccgggagaccggtcaggccctcgaccgcctcggctgccgccttcaggggaactacttctttcacgagcagatttcagggcatcgcacacttatgaacatctttgacaaagcccctcatgttcacaaaaaggcatttggcgctccaagtgcatcccttattggtgatgttgaaattggacaagggtcttcaatttggtacggctgcgttttaagaggggatgc

SEQ ID NO: 6705 - DNA, 385 bp, Triticum aestivum
  Clone ID: LIB3281-043-P1-K1-C10
gtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccc

SEQ ID NO: 6706 - DNA, 383 bp, Triticum aestivum
  Clone ID: LIB3281-043-P1-K1-C11
cggacgcgtgggggagcggcggagcggcggatctggagcgacgtcgtcgtcgtcgtggagtagctgcttcctcccgcgtgaaactggagaacgagagggaggggtagatgatggccgccatcatggatttgaatcttctgttcttacattgctgtagtactggctgcagtcttgctgtacaatcacttgaggaattcaaggcctgatgcgtccttctgggagccatggctacttcttcctgtgccctgcgtcaggagaaggagcacgcccaggagaagaaggatcgggagaaggccctgaggacctgggatcgctgctgctagatctggatctgggacctgggactgctgctgccgcgtgctccttctgggagacgaggaccc

SEQ ID NO: 6707 - DNA, 308 bp, Triticum aestivum
  Clone ID: LIB3281-043-P1-K1-C12
gttcgatcaattctaagaccaggaaaaagagaaagcattctgatcactaattgctactacatctctccacagtggtagttactaatgttcaacttaatagtagtagtttctgcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcatatataattctttcttcaatttctttattattcattttttttataataattaattaattcttttatt

SEQ ID NO: 6708 - DNA, 372 bp, Triticum aestivum
  Clone ID: LIB3281-043-P1-K1-C2
cccacgcgtccggtcaaagcagcgactgatgtcccttgcgtcgtcgccctctcttggtttgagcccccctcccagcagcaccaatgtgtctgctgctgaggatgctggagctggcaaagggaagcagccagtaacaccatctttggaggacaacaagctgcttaggcgattgagcatcgggccaaaggccttctttaggcgctctgtggagaaggacgaggaacaggataaggatgggttctttaagaggttgcttagagacagcaaggacaaggaggaggatgatggagacaaggaaggttttattaaaaggttgcttaaggatagcaaggagaaagagaatgatgaggaagaaggggataaagatggtct

SEQ ID NO: 6709 - DNA, 348 bp, Triticum aestivum
  Clone ID: LIB3281-043-P1-K1-C3
cccgccacggcaagtacatggcctgctgtctcatgtaccgtggtgatgttgtgcccaaggatgtcaacgccgctgtggccaccatcaagacgaagcgcaccatccagtttgtggactggtgccccactggtttcaagtgtggtatcaactaccagccacccagcgtcgttccaggcggtgaccttgccaaggttcagagggctgtctgcatgatcttcaactccaccagcggtgtcgaggtcttcttccgcattgaccacaagttcgacctcatgtacgccaagcgtgcctttgttcactggtacgtgggtgagggcatggaggaaggagagttctctgaggcccgtg

SEQ ID NO: 6710 - DNA, 348 bp, Triticum aestivum
  Clone ID: LIB3281-043-P1-K1-C5
cggacgcgtgggtgcggggaaatgagctcgcactctgctaaggcgctgaaggagctatcaacagccattcggacaatgatcgtaccatctccagccaacatcaccatgtccgcagccatcaaagctgcaaaagacctcagaaatgaattatcagaggaagcagctctgttgcaagtgatgcatgtggctgttactgcgacacttctctcagacttggttacgacaatagtgaaaattgcagaaaccgctgataatctagcacggcttggccacttcaagaaccctgaaaaaactcagaaagatgtcgctatcaacattccgagcagataaagacgcaaatttccttcc

SEQ ID NO: 6711 - DNA, 383 bp, Triticum aestivum
  Clone ID: LIB3281-043-P1-K1-C6
agcgcctgtgctcccatcaccctcaagctcccacctccggatcgagcaggaggctcgatggcgagctcccgaagcccaccatgccaagcgcctcgtccagggactctgcaccattccccttctttctcccatgtgtctcttccctccctcctgtgctgatctaccttcccgtctctctcctctcgcagcaatcagtaggaacccaggccaccgagctttgcagcgccgccctcgaccaggagctccgcctgactccatggccgtcgtcccaaacctctccttcgcctgcgctgccgccatggattggatccggccggagctggtcatccgcctcacctcccattctggctgcaagctaccgccgtctggatccctcccgagct

SEQ ID NO: 6712 - DNA, 387 bp, Triticum aestivum
  Clone ID: LIB3281-043-P1-K1-C7
ctctagatctcccggcgcaacaaacgcaaggccaccggcgcctccgcgcatccgcagtcgccgcctctgcgatcttgcccgccgccgccgccgctgccgccccgagagatggcaaaggcattttacgcggtggggttctggatccgggagaccggtcaggccctcgaccgcctcggctgccgcctccaggggaactacttcttccacgagcagatttcagggcatcgcacacttatgaacatctttgacaaagcccctcatgttcacaaagaggcatttgtcgctccaagtgcatcccttattggtgatgttgaaattggacaagggtcttcaatttggtacggctgcgtcttaagaggggatgcaaataacgttcaagttggatct

SEQ ID NO: 6713 - DNA, 383 bp, Triticum aestivum
  Clone ID: LIB3281-043-P1-K1-C8
cctcatattgtttcttgcacaggagacagcggcggctactggacgtgactcggcggcggcgactggacctggtggtggtactcaccggcggtggctacatccctgccaggagaccacaattcagatgagctaggtgttggagatggatgaaacggagaggggtgaccacgtcgttggagacggcttcgattttcctcttttgtttgttcccgagcagaggttaccaagatttctgtgaagcacaagtgctcctctaccggtaggataaaaaacagcatgacatctcaaggatgggtagcacagaggaccgtaccccttatacagagtgaccctacaattggatgcaaagagttgttggagaatttgcaagatacatatggcac

SEQ ID NO: 6714 - DNA, 364 bp, Triticum aestivum
  Clone ID: LIB3281-043-P1-K1-C9
caatgtattgctgagacattgaggttgaataccaatatacgcacatacaggagaaatggttgatgacaacaacagtcttgtagcttcaagagtggaacatgaggcagcctgtgtattgtggtggtgaaagagcagaggaactgtgcatgctttaatggcgcgaacgccaatcctatttattgtgtatactgactgacaggtgccacatctacacttgtaacttaaagagcggagcatgcagcagggctcttagtcgttgaggatcatgtcgacaggctctggcttatggcttggaaggaacacaagaactgtgcatcgcgggttgtcgtaaccgcacatcatatcctttgtactgttgagagtc

SEQ ID NO: 6715 - DNA, 378 bp, Triticum aestivum
  Clone ID: LIB3281-043-P1-K1-D1
cggacgcgtgggtggcctccctcatgctcgccaacgccgacctcctcctcctcgcccccaccgcccccgacaaagccgcagatctcgagtgcgtcctcaccgtcatctgcaacctcgtcaccaaggccgagtccgaggacgaggccctcgagatcgccaggctcatctgcgccaagctcgcccaccagcccggcgacaagcccacgctgcgcatcaaagtcctgttcagcctgtacaacctgctcccgagcctctccggcaaggccttggtgtacaggaaggcgctcgagctcgccgccgccgggaaggccgccgactgcgtcgtccccaccttcaagaacatcgacgcctttgtcgcctactggggcatcggcaagc

SEQ ID NO: 6716 - DNA, 381 bp, Triticum aestivum
  Clone ID: LIB3281-043-P1-K1-D10
aggtaatccaatccgcacagaaatccccatctcaaaaccctagccctcaggcccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgtcgacgagaagttcgtccacaagcacaccaagcccgggat

SEQ ID NO: 6717 - DNA, 386 bp, Triticum aestivum
  Clone ID: LIB3281-043-P1-K1-D11
gagctctctgggtcgtttcgtgctcatcatctggctgttcgtggtgctcatcatcaactcgagctacacggcgagcctgacgtccatcctgacggtgcagcagctgtcgacggggatccaggggctggacggtcttctcgccagcgccgaccccatcggctaccaggttgggtccttcgccaagagctacatgatgcaggagctcaacgtgccggagtcccggctcaaggaacttgccatcgacgactacgccgccagcctccagctcggcccgcgcaacggcggcgtcgctgcgatcgtggacgagctgccctacgtcgacctcttcctctccaccaactgccagttcaagaccgtgggacaagaattcaccaagagcggatggg

SEQ ID NO: 6718 - DNA, 173 bp, Triticum aestivum
  Clone ID: LIB3281-043-P1-K1-D12
cggacgcttggggtggtattgatgtcaatctgttaccactcgaaccctaactccttgaaaaaagatgcacctccaggcatagtcgtctcccattgcgagaggaggagacttgagcgatatcaagttgacactggatggtcttggtggacaggcacacctgacgcttcatgaag

SEQ ID NO: 6719 - DNA, 379 bp, Triticum aestivum
  Clone ID: LIB3281-043-P1-K1-D2
cccacgcgtccggagagcgcggccctgctcacgatcccgtcctccccactctgctgcctcaggttgatgccggtcttccattcgtcggcgaccatccgggcattcaccagctgatcccacgcgacggggaagccaatcaccggcactccggcgcacacggcctcaagcaccgagttccacccgcagtggctgaggaagccgccaacggacgggtggcgcagcacctcctgctggtcgcaccacggcaccgccaaccccttgtcgccgcacatctcccgcaggccggcggtggccctgtcccgggccacccagaagaacctgaccgcgctgtcgcgcagccccacggcgatctcctcgaactgcttgggcggcatggcga

SEQ ID NO: 6720 - DNA, 362 bp, Triticum aestivum
  Clone ID: LIB3281-043-P1-K1-D3
cggacgcgtgggcacggtcattgttgctcagaaaaaccatcataccaggtgtttccagacaaactcgccagaaaatgttcctcctggcactgtggtggataaacaagtgtgccatcccaagaactttgacttctacatgtgcgcgcatgctgggatgattggcacgtcgaggccaacgcattaccatgttctgcatgatgagatcggcttcagtggggatgagctccaggagtttgtgcactcgctctcctatgtgtaccagaggagcacgacggcgatatcagtagctgctccgatagcgtacgcgcatctggcggcggcgcaggtgggcaccttcatgaagtttgaggacatgtctgaca

SEQ ID NO: 6721 - DNA, 143 bp, Triticum aestivum
  Clone ID: LIB3281-043-P1-K1-D4
aggaggtttttttagataaacttgcctcattctgttttttctgcactataatagtcagtctagcgttctcacccaagaacttgggtggtacttttccgagcctgcgtccatgttaatgaagaaatattcctgcgcacttccaa

SEQ ID NO: 6722 - DNA, 386 bp, Triticum aestivum
  Clone ID: LIB3281-043-P1-K1-D7
cgcttccagtgctagtgccgccagcaccaccacgggaattgcagtcgcaaccagatggcacgccaccaccgcgagccactcgtcggcgaccaccagcccatgtgcgcacacggggtctcatgcgcggcgccgctgatggggattgggcgtgacctgcacctggaggaggcctcgacctgtagctagaagaggcctcgacctgcagctggccgcgcgccgccacactagtctacaacctacagctggcgccgcacgcccaggccgttcaactttggcacaccaggtcgttcaactccgcccgtgctcctcttagattaccttcagtcaagattgaacacaaaatatcaatccattcggtacagtgcggttgtcttgattagtctttc

SEQ ID NO: 6723 - DNA, 372 bp, Triticum aestivum
  Clone ID: LIB3281-043-P1-K1-D8
tcctcccttcaagcgctagtacagccaggaccacctcacgaatcgcaccttcaaacggaggttactcacagcagctgccagccattccattcgcgaccacacacatccatgtgctgcaacagcttatccaacgcgacggccaagccaatgaattgggcttcacctgaaactggaggaagcctcgacctgtacctagaataggtctggaagtccaccacggccggctcgggcacaatcttctacaggttacaccacggcgccgacaacccattcggttcaaacatgtcacacaaggccgcagaagtcctgtcgcgcttcactcagaataccttgagcgaagattgaacacaaaatatcaatacattctttaca

SEQ ID NO: 6724 - DNA, 386 bp, Triticum aestivum
  Clone ID: LIB3281-043-P1-K1-D9
atgcagtgtacaaatacaggctacggagttacatggattcggagatccgcgcgatcatggctcagtacatgcctttggacagtcaagaaggcgcaaaccagcaacagcatgtcgcgcatgctggtgatatctgagaccagatggcactgcttttgctgagcaacacagaagcgtgcagagtatgtattatcatcggtggcgtcggctttacagcgcgaagcaaagatacgggttgtacgcgaggagatttgatgtatgattctagagagttacactgttgtgcaccttcattttgtgagacacgatgcacagtataggcggatattgtcacggttaccctacttcctttgttggctctagactcattgcatactacgaacgttcta

SEQ ID NO: 6725 - DNA, 387 bp, Triticum aestivum
  Clone ID: LIB3281-043-P1-K1-E1
cggacgcgtgggggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaa

SEQ ID NO: 6726 - DNA, 387 bp, Triticum aestivum
  Clone ID: LIB3281-043-P1-K1-E10
caacaattcccaaaccaggagaaacttgatgatcccaaactgtatcactatgccttgttctcagataatatattggcaacagcagttgttgttaattcgacagtgttaaatgccaagcatccttctcgtcatgttttccacatagtaactgacagactaaattatgctccaatgagaatgtggttcctctctaatcctcctggaaaagcaacaattgaagtacaaaatattgacgaattcacatggctaaatgacagctcgagcctgttgctgaaacaactgggatctcaatctatgatcgattattactttacggcacaaagtgcaaattcagattcatatttgaagtacagaaacccaaagtatctttcaatgcttaatcatctg

SEQ ID NO: 6727 - DNA, 364 bp, Triticum aestivum
  Clone ID: LIB3281-043-P1-K1-E11
cccacgcgtccgcagtgattgagtatctgtgcaacaatgggaataccaacaaggctgagacgttcttcaggcagctgatgaagaaaggtgtggatgacaagtctgcattcaacagtcttatccgtgggcatgcaaaggaaggtgcgctggaggctgcaaaggagattcttgccattatgacacgccgtggcgtccctactgacccccactcgcacgcactgcttattgatagcttcctgaagaagaatgagtcagctgatgcaaagacagcattggacagcatgatggaacatggtcacttaccaaggccagctctgttccagtctgtcatggtggcacttttcaacgatggccgggttcagac

SEQ ID NO: 6728 - DNA, 316 bp, Triticum aestivum
  Clone ID: LIB3281-043-P1-K1-E12
ctcggccgttctaccaaggccaagctagggcacggcggccgtcaggtctggagcgagcaacaccggccctctggacaagagaggacctgctccgtgcagcggcaccgggtccgcgtcaagacaaggggaaaagctcctgcaatcaactgaaggcatggcaaaggcgggagagaacagctttgaggatgaaatcatggagtcggacatcgaattggaaggggaagttgttgcgccagacaatgatcctctgcaaaagatgggagatccatctaatggagccgttgcagaaatgcgcgacaaggcacaaatctacaaa

SEQ ID NO: 6729 - DNA, 367 bp, Triticum aestivum
  Clone ID: LIB3281-043-P1-K1-E2
cggacgcgtgggcccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagttgatggccattgggtcgttcaaggagcagttgatgtggacattggagccaatccctctgctgagggtggtggtgacgatgagggtgtcgatgaccaggccgtgaacgaggctgacattgttgacacctttcgtcttcaagaaccacctgctgttgacaagaagcagtttatctctcacatgaagcgctacatcaaagacctcact

SEQ ID NO: 6730 - DNA, 387 bp, Triticum aestivum
  Clone ID: LIB3281-043-P1-K1-E4
tccaagactacttacgcgtagcctgcgacctcctaactcttctatcgtgagggggaaattcaattcagtggccgtcgctttacaatttttttactcacaaaccccggaggggtacccaactgaatagtctttcaagacataccactttcgtcaggtcgcgtaatatgctatgaagctcggaccaatctgacttcctaacagttggccaggctgaatggggaatgcgcccccccttgcatcgggccattgagcgctacgcgggtggtgttttcacgcaggtggagggctataattgtcatggccctatcatcctttttgttcccaagttgctcttcctttttttatacgtgggccagcttcccgaggttttttttaaagcttaatcat

SEQ ID NO: 6731 - DNA, 341 bp, Triticum aestivum
  Clone ID: LIB3281-043-P1-K1-E5
aaggggagaagctctgagcatgttgcacttaatctagttccaaacaatgtcttgagttttcaacacttccgatatgcacttccagtaaaaagagaacagataaccactaaccacctataacagacaaatgcactgcacaaatcttaaacagcagagaagtccctagggtggcaacagactggcagagaaaatattctgtgtccgaccgaagaatcccgcaaaacaaatctacaaaccgcttgcaaatcacaccaggtgtgccatttcgggctaagaagcgctgggaagtctcatgatccaacacctcctaagccccgggtgctcgggccagctcagaggct

SEQ ID NO: 6732 - DNA, 381 bp, Triticum aestivum
  Clone ID: LIB3281-043-P1-K1-E6
ggggattcttcctggagcacattgtccacaatttgcaattgcagcgagggtctgggtgatgcattgttagggaacatcatatttacggccatgttactcctgggagtacgatatatcctcaaattttcttttgacattacaaggtatcgagagattctgttagccgtcatcatttcaagctatttcaagttatttcttctgacaatgatggtttgggagttcccatcatctgctatattcattgtcgaaacatttgttctctcatcaaatgttgtaaccctgagagtggtgacgcggttcccaaaagcccactgtgttggtgtctgcttcatggcgcacgcggcaaaacacttgacggaacggtggctcatgtggacacca

SEQ ID NO: 6733 - DNA, 299 bp, Triticum aestivum
  Clone ID: LIB3281-043-P1-K1-E7
ggaacatagttgagggcaactccatgttggcgaacaagtttaattctgatataaggttacattattttcagctccatgcagtttgtttacagggttcattgcatggcggcctaactatagaacatcacccatagtgacgaggactactgggcgttcgaaggcgtggtcttgcttttattcctaaaaccgggggctgtcatctacagagcggattgtaacagcatcttagccagttctctgtttgccggatggaacgggtagctcaccccactccaagacctttttttctaagcgtttaa

SEQ ID NO: 6734 - DNA, 366 bp, Triticum aestivum
  Clone ID: LIB3281-043-P1-K1-E8
gcggatgggcgctcctcaacgccttcgccacggtctgcggcgtagcaagcgggtacatagccgagtacatccatgtctcgtgcagccagtcctccttcattctgccctgcatcgagctgacagacgcggaggccgcgagggtaatcgccctctgcatcgggatgatgtgctgcgccccaaccctggcagccgcggcggcgctggcgctgctgctcccatgccgccgtcgccgggcccgccgtgccctcgcctacctcgcccttgcggtcaccgtcctcttccattgcatgtacgccagcgccgtctggatcttcctcgccgccgacccaggatacatcttcggcaggatctacttcaccgcgggct

SEQ ID NO: 6735 - DNA, 370 bp, Triticum aestivum
  Clone ID: LIB3281-043-P1-K1-E9
gtccacttgttgcacactgtgcaccatgagaccaaggtaaaagtgatgcctggagttgaggacctcttggactattcatcgattcagaagttgtttttccttggcaacacggatgaagatttttctgtcctcacacggcattggtcggaactaacagaagggaaagcatgtgttatcaaagagcgaccaaatgcaattgagattgttccccttaatgcttcaaaaggtggtggtataagggctctacttgatcatctgggattaactgaacattctgatcttgaagcggtcggagactataccagatggctaagcaacaagtgatccaactgacatgacaaagcattctttatcttgagagtgatgattg

SEQ ID NO: 6736 - DNA, 383 bp, Triticum aestivum
  Clone ID: LIB3281-043-P1-K1-F1
ggggcccgacgcacccgacgaggacgctcacactcccatcatccaccgcgacatcaaggccaggaggatccttctcgacgaacgctgggtctccaagatcgccgacttcggcatggcccgcctcttcccggaggccgacgacggccactcccacgttcagacccgcgtcgtcggcaccaacggctacatgtcgcccgagtacctcatgcacggtcacctctctgacaaggccgacgttttcagcttcgacgttctcgtgctcgagatcctctccggtcgaaagaactacttctttattccagcgtcctgatccaacgccgacaatcttctcgattacgcctggaagctgtacaaggaggagcggggcctggatctgctggacc

SEQ ID NO: 6737 - DNA, 388 bp, Triticum aestivum
  Clone ID: LIB3281-043-P1-K1-F10
agaatatgcagaagttacatgaatcggcacaaagccaattgtttgagctgggtactcaatcagaggaggaccggacagcaaaggaagctgaagtgagccttctgatggatgaagttgaacgcgctcaatcacgattagttagccttgagagagaaaagggggatttacggtctcagttgcagacaacaaatgaagacacaagtaataatagtgattacatggacccaagtgatatacttgagagttctttgaatgccaaggagaagatcatatcagagttgaatgcagaactgcgtaacattgaaagtactttatcaagtgagaaagaaatgcatgtgaatgaagtaaagaagttgactgctttactcattgagaaagaaactgttat

SEQ ID NO: 6738 - DNA, 394 bp, Triticum aestivum
  Clone ID: LIB3281-043-P1-K1-F11
cggacgcgtgggagaatttgaagattacgggaagcgcaaatgaattttcatatgcgatgatggtgtgcttgtacaagaaagttgctcgctatgatgaagctcacaggatctccaaggaaatgcaagctttagggcttctaactcaagcattaagttataattctgtgattcagatgtatgtatctggtgggaaaatggaggaggctgtgaaaatatttcagaagatgttggcatcgagcacaccgccaaacgatgtaactttcaaggcactaaagccaatactagtgaaagaaggagtttcaaatattgagattgcaaaattagagtctctcagaaggtgtaacactcaagattgcttgaatcagtggtacagggcactagctctggttgtcag

SEQ ID NO: 6739 - DNA, 355 bp, Triticum aestivum
  Clone ID: LIB3281-043-P1-K1-F12
ctggggaattactggggggaccaacccctcctccgacgatttctatccacagccgatgaccgccgtatttcgagaggttcgagctcgccggagagggacgagagatggtcattatggccctcccgaagaatatagtggggacccggtccaccaaggccgagctccagttcctcgtcgggcgcatcagacgctttcttaagaagggccgctacacgcagcgcgtaggtttcagagcccacgactacctcgtcgtagtgctcgagtaccttgtcgacgaggtgctggagcttgttcgtctcgccgccaaggacaacaagaaagacgcgtgtgtgccctatctcctatgctagttgat

SEQ ID NO: 6740 - DNA, 378 bp, Triticum aestivum
  Clone ID: LIB3281-043-P1-K1-F2
gccgccgctcgcagctccctcctgcgcgagctcctctcgcgcccgcaagacgcctcgccggcgaccccacacctccgccacgccccgccgccggcgaccttccccgctggatctccgacctccatggtgtcgttggccttcaatctcgctggatccggccgcctccatgccaaatccaccggaaatggatccaccccggccagatctgcccggatccaaccgggccccgccgtcgtcgccaccggagcgccgccccgaaattttggttcagactgctcttcaatccttgctgatttgtggttttgagacccacccaagcagggctgcgctcaggagaagaacctgctgttcctggaggcctgacagacagccgatccc

SEQ ID NO: 6741 - DNA, 310 bp, Triticum aestivum
  Clone ID: LIB3281-043-P1-K1-F3
aacctccactgccattgtctgctatggcagctcgtcctttcccacgagagggcctttgctcccagcctactacctctagatctctctccgtctgcgatcaaatgggatccatctctgcgctctatggcttcgccttccactaatccggctatacccatgctagtgaaggccaaatacatcacaaattgaatcaccccgtccagatctgcccggatccaacgcttcttatgctgttttcaacaccgtaaggccatcctgatatactggttcatactgcatcttaatccttgctgattcgtcgttttaaaac

SEQ ID NO: 6742 - DNA, 391 bp, Triticum aestivum
  Clone ID: LIB3281-043-P1-K1-F4
agctcacgcgcacacggcagaacccaatcgcagcccacgccccctgacgggaccggatcgagcctcggccgagggcatgggcggagcaggcgacggcgagggggccgggagcgagtccccgccctcgggcgcgcgggcgacgctcaacatccggtgcgccaacggcgccaagttcaccctgcaggcggacctgggcgagacggtcggggcgttcaaggaggtcgtggccgggagctgcgacgtgccggcgccgcagcagcgcctgatctacaagggccggatcctcaaggacgagcaaacccctaaagctacggtgttgagacagatcacaccattcacttggtgcgaggcgttgcccaaccagcagcatcaggagcacctgctgcagcat

SEQ ID NO: 6743 - DNA, 352 bp, Triticum aestivum
  unsure (1)...(352): unsure at all n locations
  Clone ID: LIB3281-043-P1-K1-F6
agcatttctatccaccgccgacgcccgccgtattccgagaggttcgagctcgtcggagagggaggagagatggccaggatgggcagagagaggaagaaagcggtgacccggtccaccaaggccggcctccagttccccgtcggccgcatggggcgcttcctcaagaagggccgttactcgcagcgcgtaggctccggcgcccacgtctacctcgccgccagtctcgagtacctcgccgcctaggtgctgaagctcgccgtgctacgccgccaaggtcaacaagaagacccgcatagnnccncgccccctgctcctctgcattcncaactaccaggagctcggcnagctgctc

SEQ ID NO: 6744 - DNA, 399 bp, Triticum aestivum
  Clone ID: LIB3281-043-P1-K1-F7
cgcgggggctgctgtacctgcacgaggacgcgcacacgcccatcatccaccgcgacatcaaggccagcaacatcctcctcgacgaacgctgggtcgccaagatcgccgacttcggcatggcccgcctcttcccggaggccggcgacggccactcccacgtccagacccgcgtcgccggcaccaacggctacatggcgcccgagtaccttatgcacggtcacctctccgccaaggccgacgtcttcagcttcggcgtcctcgtcctcgagatcctctccggccgaaagaactccttcttcatcccgccgccccgatccagcgccgacaaccttctcgattacgcctggaagctgtacaaggaggagcggagcatggagcttgtggacccgtcggtgaagt

SEQ ID NO: 6745 - DNA, 385 bp, Triticum aestivum
  Clone ID: LIB3281-043-P1-K1-F9
gagcggttgagcggcgcgtagcacgaggaggaggaggcgaccgatcgatctggagctagagagcccggacgctgagctcggaggcgacagcatggtgcgcggacggctcgagctcaagcggatcgagaacaagatcaaccgtcaggtcaccttagccaagcgccgcaacggcctgcttaagaaggactacaagctatgcgtactttgcgatgccgaggacgagctcatcatcttatacaaccgcggcaagctctactagttctgcagtgaacatagcgtgcccaaaacacttgagagataccataaatgcagttatggtgggccagatacaggagttcaaaataaggagaatgagttagtgcagagcagtcgaaacgagtacctt

SEQ ID NO: 6746 - DNA, 234 bp, Triticum aestivum
  Clone ID: LIB3281-043-P1-K1-G1
cccacgcgttcgaccagcagctgcacgacgagctcgacgccatccaaaagagccaagaaactagtggagaagtccttgaagcaacagcatatgttgcaacatatgctagctaacatgccaccggatatgcgtgcggctattgtggctactactttggaacaaagcttagatgtttccttagagctcaaattttaacacatctgtttcatcatatctggacattaatgttaagat

SEQ ID NO: 6747 - DNA, 394 bp, Triticum aestivum
  Clone ID: LIB3281-043-P1-K1-G10
cccacgcgtccggttcaccgtcatgttcaggaggaaggccttcttgcactggtacacgggcgagggcatggacgagatggagttcaccgaggccgagagcaacatgaacgacctggtggccgagtaccagcagtaccaggatgcgacggtcgaggaggaagaggactatgaggatgagcaggaggatgaggaggccgcctaagcgggcttccccctttcttcccagggatatgccttatatatcgctcgttatgtcgttggagtgctcgtggtgctgttaggtgatgatagctagatgctatttttttccgttctaaatgtcggtcgtgttgccttgacagacttattttttcgttatgtggacctgtggttgtcgtgtatgctcatgtcgtga

SEQ ID NO: 6748 - DNA, 114 bp, Triticum aestivum
  Clone ID: LIB3281-043-P1-K1-G11
gtttagactaggtttttagtaacaggaggtaaactagaaactaaatggggcaagttgaaacttttaaattatataaaactttaaatatccaaggtaataatttgtttttgtttc

SEQ ID NO: 6749 - DNA, 307 bp, Triticum aestivum
  Clone ID: LIB3281-043-P1-K1-G12
ggaattacagcgcgagcgacccacgcgtccactgacacgtggacctccacacgtgtctccctccacagaaaggctaaagagaaccgttatgcggagcgcccgcctcctacggctcagcttctgtcacgtcccttctcttctcttccaagggcccctgtccccctccccgagcccggacctggacctgggcctgagcgttgccagagtcgtgttggtccatctccgatgctcggcggccgatgccggctactgcaggtgtaagaaggtgtcatcgcgactagcattggcacagcatgtgatgcactac

SEQ ID NO: 6750 - DNA, 292 bp, Triticum aestivum
  Clone ID: LIB3281-043-P1-K1-G2
cccactcctaaaccctacatcttaacgcagagctcaacgcctttcgaaaggggaatatattattgtacacgccttttaatccacaccataagctgctagatatactagcaatcatccatgctgacatccatgcagtttgagaacaactttgaatgtagtatatcttgcaatctcacaaatacttactttttaacatcaaatttgacaatcaaagaatactttcattacattataatctgagcttccatatctcattcctatgaacaacacctctatcggttgcactagaata

SEQ ID NO: 6751 - DNA, 386 bp, Triticum aestivum
  Clone ID: LIB3281-043-P1-K1-G3
cgcgctcccaaaccctagctcccaccgcagcggccaccgcctctcgaccggcgcccctctcccggtgcgcgcctgttgctgcagacgagaagcggctgaggcgaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctgg

SEQ ID NO: 6752 - DNA, 369 bp, Triticum aestivum
  Clone ID: LIB3281-043-P1-K1-G4
cggacgcgtgggcggtcgcttggagcatagtgagcaatgcatattgccgggacaaagaggtcatgttgcctgctttaggtctaaatcagaactcggagtgggacttaggagtgttcttaggcatcgccgatcgtcgagaagcccgacccaacgatctacaagatcgcgctagagatggcggcgtacgttgtaccagaagaggcgctccacattggcgacagctaccgaaaggactatgtcctcgcacgaagcattggtatgcacgcagctgctcttggaccggttcaagactcgtcgagccgatagctggaggaagtatgacgcacctgttcttgctgaactcgaggcctggcaagcatggttcaccaa

SEQ ID NO: 6753 - DNA, 238 bp, Triticum aestivum
  Clone ID: LIB3281-043-P1-K1-G5
cgcacgcgtgggcggacgcttgagtcttctcaagctcaaacattggcggggacacagaagccgttatgtcagatcaaacgcttaataaaggctttgattcattagtttatatggttatgattcttgattaaattcaagaacggcctcgtagaatcttatcttgtccttgcttatgatacgcatgtcatattacaacaaatgacttacagatagttttaatgtacgcttccgttgatag

SEQ ID NO: 6754 - DNA, 92 bp, Triticum aestivum
  Clone ID: LIB3281-043-P1-K1-G6
acgcgaccgcccactctcactgccaccacctccgtctagtgccgcgctctgggcggtaccaaccgaggcattgtatcacgatcacccacccc

SEQ ID NO: 6755 - DNA, 385 bp, Triticum aestivum
  Clone ID: LIB3281-043-P1-K1-G7
cggacgcgtgggtgccgctctcgctccgcagacgccgccgccgccgccgccggggcggccagagctcgactcgctccctagaggtaaggatggtgagagtcagtgtgctgaacgatgctctcaagagcatgtacaacgctgagaagcgtgggaagaggcaggtcatgatcaggccttcttccaaggtcattatcaagttccttatcgtcatgcagaagcacggatacattggcgagtttgagtatgttgatgatcacaggtctggcaagatcgtggtcgaattgaatggcaggctgaacaagtgtggtgtcatcagtcctcgctttgatgttggtgtcaaggagattgagggatggactgcaaggctcctgccttctcgtcagtt

SEQ ID NO: 6756 - DNA, 383 bp, Triticum aestivum
  Clone ID: LIB3281-043-P1-K1-G8
cggacgcgtggggcaaagagtgcatgtaggtgctgctgctctacgaaggcctggttgcccggacagggtcacggcgctggagaagactgacagggaatttgccgagcatccaggtgacatagttatggtgccaaagattggaacaaattttgacacgctcggagaagcttatgacttttaactcctggaagaaaggatttggaatacgatatggaaagagcaggctaaacgttagcaggactaagtgtatgcaagatatagtctgtggatgcgcggggaagccaatcgtagaaaatactcgttcatgccggtgagaatgcccagcccttatcagactactgcggacaaaggacaatgggtggtacgtagcaaagcaccgagat

SEQ ID NO: 6757 - DNA, 333 bp, Triticum aestivum
  Clone ID: LIB3281-043-P1-K1-G9
gcgattccccttcgcgcagccgtaccacgtgtctcccgtagcgcaccttttctaagcgggctccatggcggaccagctcaccgacgagcatatcgcctagttcaaggaggccttcagcctcttcgacaaggatggcgacggttgcatcaccaccaaggagcttggaaccgtgatgcggtccctagaacagaaccctacggaggcggagctgcaggacatgatcaacgaggttgactcggacggcaacggcgccatcgacttccgtgagttcctgaacctgatggcgaggaagatgaaggacactgcctcggaggaggagctcaaggaggcgtt

SEQ ID NO: 6758 - DNA, 384 bp, Triticum aestivum
  Clone ID: LIB3281-043-P1-K1-H1
cggacgcgtgggccgaaaaatgttcgccctccgcaaaaccctgctccacgggcgcctccccgcgccgccggccaccgccgcctccaggatctcctccttcctccgctccctctccacatctccggggggcgagggggtcggggacgaatggggctcctcctggtccaccggcatcaccaaggaccacttcgacgggtccgcctccgccgtcgggcgcccctccccgtccgcccccgtctccaaggagctggcggccgtccgcaccatggacgaggaggatgagatcctgcgctccgtggatcgcgacaacaaggaagggagggcgtacgtcgactcgtgggacaagcgttttcacgagacgtgcgagctgctgaagcaggtgcg

SEQ ID NO: 6759 - DNA, 425 bp, Triticum aestivum
  Clone ID: LIB3281-043-P1-K1-H11
ggccgggaaggcctgggtggaccgacccatgcgtcaaaatctgcatagattcaaattcgagttgccttgcactctactcaaagcttagaccagatcaagctttgatgctgcaatcgcccattactctaccaaaggctgtcaagaatcccatggagctgactggtttgaggaaggcacacattcgagatggcgcagctgttgtgcaatacctggcttggctggataatccgaagcaagagaactatggggcctctggttacttgagtgaggccaatggatcacagaaaaaagagcatttggaaataaaacttactgaggtttctgtcagtgataaactcgaagccttccgtgcggagaaagagcattttaaaggtttaagttttcctacgatatcatctgtggggccaaatgcagcaataattcac

SEQ ID NO: 6760 - DNA, 364 bp, Triticum aestivum
  Clone ID: LIB3281-043-P1-K1-H2
cggacgcgtgggccctaaaatagttcgtccttcacaaaaccctcctccaagcgcggctccccgcgccgccggccaccgccgcctccaggatctcctccttcctccgctccctctccacatctccggggggcgagggggtcggggactaatggggctcctcctggtccaccggcatcaccaaggaccacttcgacgggtccgcctccgccgtcgggcgcccctccccgtccgcccccgtctccaaggagctggcggtcgttcgcaccatggacgaggaggatgagatcctgccctccgtggatcgcgacaacaaggaagggagggcgttcgtcgacttctgggacaagcgtttttacgagacttg

SEQ ID NO: 6761 - DNA, 265 bp, Triticum aestivum
  Clone ID: LIB3281-043-P1-K1-H3
ctcactcgtgaccttaactcttatctaccgacacaccctctccaggagcgggtttttcacggcgcccgcctcctgctgctcacgaaaagccactttcgtgcattggaattgaccatggccacccccatccagcttgagaacaactctgaacttggcgttgactccaagcttacaaaggcctactcattgcctacactcggaggaccagacaatctccacagtgcatttgaatgtgtccttgcaactagcattcgtgcggtcaata

SEQ ID NO: 6762 - DNA, 182 bp, Triticum aestivum
  Clone ID: LIB3281-043-P1-K1-H4
ctactcgtgggcctccacacttgtcttcctccacagaaaggctaatagagaaccgttttgcggagcgcccgcctcctactgctcagtttttgtcacgtcccttctcttctattccgagggcccttgtcctcctcccctagcccgtacctgggcctgggcctgagcgttatcagtttcggttt

SEQ ID NO: 6763 - DNA, 369 bp, Triticum aestivum
  Clone ID: LIB3281-043-P1-K1-H6
ccgcggacgcgtgggggagagcgagaggggcagcgtggtggcccgcaaggggagcaccatcacgggagccgcgttctcccggtccacggccacgtcggggagatgccgcctaccttcgctggcgagcggcggctgtgagagtctggtgcggagggcggactcgatcatgaagtcgctctcgtggtccaaggcggtcccagtcacggagacggccatccgcgccgtcattggcgacaacgctgtaactagcaaggctgtgcgctggttgctgaaacataagagagggttgcgtcgtgcgggcactggtggccgcccggatccgtatgtgtacatggcacttcttgttctgcaatccacgagcagggagcg

SEQ ID NO: 6764 - DNA, 141 bp, Triticum aestivum
  Clone ID: LIB3281-043-P1-K1-H7
cggacgcgtgggcggacgcgtgggcaggggttggcttcttcttcccactcaggagtgggttttcagtccgtttcgcctctttagggtttattattggtgaagaggaggaagaatggcggacatcgagtaccgctgcttcgt

SEQ ID NO: 6765 - DNA, 323 bp, Triticum aestivum
  Clone ID: LIB3281-043-P1-K1-H8
aggacttgccctattgatctgaaagaggcaatagctagtgttatatttgcatagatgagatgttcagatgtcacacaactagcagatgttcggaagaatttcacaagcaagtatgggaaagaatttgccacatcagctcttgaagtgcgacctgacagtggcgtaaaccgtctggtaatcaagaagctctcagcaggagcaccagatgtacagactaaaaccaaaaccttgagctcaattgcggcagagcacaacatataatgtgagccaaaagcatttgaggagcagaagcaaaatgtagatcggttgtattgatcaacata

SEQ ID NO: 6766 - DNA, 386 bp, Triticum aestivum
  Clone ID: LIB3281-043-P1-K1-H9
caaatacttgaatctaacaagacctacaatgctagattactgcatatctgttggggcagttgcatatgatttttatgacccatgtatcaaaaagctacatgcaactgcccaaacaaatacttgaatctaacaagacctacaatgctagattactgcatatctgtttcattttccactactgaccaaatttttacagttggaattcgaagaagcattctccgacttaaaagtatatgttgttaaatcatgctggtgtttcactgaagttctgtagtaccttggtagtgggcacctcaaactcacagaagcatgtagtatttagtgtacatctcaaccaaagatcaacatcacaattgaaatggtaacttataaattctatatagatt

SEQ ID NO: 6767 - DNA, 228 bp, Triticum aestivum
  Clone ID: LIB3281-044-P1-K1-A10
aaaaaaaaaaattcggttgttctatataatccaagcttacttaagaaaagatgcatactaagagatctcttatatagtcacctaaatacaattaactaaccgtccttttacaacgatctgactgaaaaaacaaacacggtacccaactaaattaactagcaatacatacatttttctttagctagcttaataaataataaagtatcactgatcgatcgtcactaacaa

SEQ ID NO: 6768 - DNA, 312 bp, Triticum aestivum
  Clone ID: LIB3281-044-P1-K1-A11
tcgagttgttatatgtgctgctgaattctccattagggacttgatggatgggggttgctgacttcattgttgattgttgattgtcgagagaaaatccaggagagcggttgatgctagcgctggcgatgcgtcatctcccgtccacgcagcctccccactatgcctccacacccagattcgagtcctctcggtctcccttccccatctgtggtcggcaacgtcagtcacaatgatagcgaagtggtgcgaccaggggatggcgcacatacgttgttgccgtctgctggcctatgctctcgttcaagaatgatg

SEQ ID NO: 6769 - DNA, 198 bp, Triticum aestivum
  unsure (1)...(198): unsure at all n locations
  Clone ID: LIB3281-044-P1-K1-A2
tcgcggattcgtggtaccacattcacaccaattttttccgtctgnctttctggtcggcggaggctttcgacgaaccctagcctttctaggaacgccaagatccccaaggccggcgacgatggccgcggttcggtgcgcggtgaggaggctcggtggttctctgctccagcgaacgcaggcggtggtcgcggaggaggg

SEQ ID NO: 6770 - DNA, 394 bp, Triticum aestivum
  Clone ID: LIB3281-044-P1-K1-A3
cggacgcgtgggttacagggatcatccttttcgtctcaactctcattgggatttgcttgctcatgaacatgccgcttacgagggacacactcctatattcaaatgccaagattgattagtttgtgctacatacgaattttcacacgatgacatgaaagttttcaacagtcatgcttggtttttcctttggatcctggggtttacagtaggaacgtgagtgtgggcttgctgttcatgcagtgtagcataaaaatactgttgctatgtccttcatttagaatcatactgccactgcctgtttgggcttctcatgtttttccgtaaataaataacaatattcgagtggggtttattttgttaatatcggtcatgattgttttttagaaaaagcagt

SEQ ID NO: 6771 - DNA, 384 bp, Triticum aestivum
  Clone ID: LIB3281-044-P1-K1-A5
cggacgcgtgggcgcaccgaccacatcctcatcgtctccaacctcgggggaaccgtagctagccccaccgaagccggagcaagccgagatgtctcgcaccggaccgatcgcccaggactgggagccggtggtcgtgcgcaagaagctgcccaacgccgccgccaagaaggacgagaaggccgtcaacgccgcccgccgcgccggcgtcgacatcgacatcgccaagaagcataatgctgggacaaacaaagctgctcatagcaccacatcgctcaatacaaagaggcttgatgatgatacagagaatcttgctcatgagcgtgtgccgtcagacctgaagagagcattatgcaggctagaacggacaagaagctcacacaggca

SEQ ID NO: 6772 - DNA, 345 bp, Triticum aestivum
  Clone ID: LIB3281-044-P1-K1-A6
cggcaatctccagccaagcaatccccacacatctgtccactcctcgaatgctctggtcaccaccagcgcagcagctcgccatggacgcctcagccaccgtagccaccgggaaggggaagaagggcgcggccgggcgcaaggcgggcggccccaggaagaagtccgtgtcgcggtccgtcaaggccgggctccagttccccgtcagccgcatcgggcgcttcctcaagaagggccgctacgcgcagagcgtcggctccagcgcccccgattacctcgcggccgtcctcgagtacctcgccgacgagctgctggagctcgcggtcaacgccgccaaggacaacaaga

SEQ ID NO: 6773 - DNA, 375 bp, Triticum aestivum
  Clone ID: LIB3281-044-P1-K1-A8
gcagctgagaacactcttgtagtatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctttggacctctgataacgcagaggagggtggtgatgagatcaaagaagccgcctcaaaaccaggaggagaggggcactggttggcccggccttgagcgtgcccaaagttatttttg

SEQ ID NO: 6774 - DNA, 119 bp, Triticum aestivum
  Clone ID: LIB3281-044-P1-K1-A9
aaaaaaaaaagggcgggcggtctatatgaaccaagcttacttacgcgcgcatgcatactaatagctcttttatagagtgacctaaattaaattaactgaccggccgtttacaaacaacg

SEQ ID NO: 6775 - DNA, 176 bp, Triticum aestivum
  Clone ID: LIB3281-044-P1-K1-B1
catctttattattcctaaaaatctttatctacatcccatccgaggcgaagcggcgattcatatccaggtccgttgcgcctgccgctaggcggcttgcccggagtgggcggtggtggaggtgcatggcgtgctgtagtcgcagccctgtttctccggccgtatccagggtctccaca

SEQ ID NO: 6776 - DNA, 394 bp, Triticum aestivum
  Clone ID: LIB3281-044-P1-K1-B10
gacaggagggacagggggcaaagcaacaacaacaactcttttcacaagattgacaagaggaactacaagtgccataattgtggtaatacaggccacttcaggtcagaatgcaccaagaagaggaagccgaatagcgaaaggaataattttcacaaggatgacagccgcaaggggaatcaatcccctgaagctgcaggggtttactgatgctgattggcaaggggatcttgatgaccggaaatcaacttctggttatctgtttacactagcaggaggagctatttcttggagtagcaagaagcaagattctgtagcactttcatctatggaggctgaatatattgcagcgtcggaagctgtgaaagaaggtgtatggttaaaggggtttcttgcg

SEQ ID NO: 6777 - DNA, 395 bp, Triticum aestivum
  Clone ID: LIB3281-044-P1-K1-B11
cccacgcgtccgaatcttcagaacttggagtgctgcctttttgttctcttcccatacttctccagaaggacttggcttgtcaggaattgtttctatactattcacagggatggttatgaagcactatacgtactctaatctgtcagataactcgcagcgctttgtttccgccttctttcacttgctatcatctttggctgaaacatttgtcttcatttatatgggctttgatattgccatggaagagcatagctggtcacacgttgggttcatcatcttctcgattatatttataattgttgcaagggcagcaaatgtcttttcttgtgcctacttggttaatatatcgcggccagaacatcggcgtatacctctaaatcatcagaaagctcttt

SEQ ID NO: 6778 - DNA, 133 bp, Triticum aestivum
  Clone ID: LIB3281-044-P1-K1-B12
gacagacgtgaaaattttcagatcatgtagagcgctctttttggtatcgggtaatacttgagcagaaggacttagcttgtgaggaattgtaatctatattattcaaaggaatggttatgaaatactatacgta

SEQ ID NO: 6779 - DNA, 351 bp, Triticum aestivum
  Clone ID: LIB3281-044-P1-K1-B2
cggacgcgtggcctgaaaatggttatggttcttgatcgtatgtatgagcggatactgttctatgattactagatgaagctacaatggttaacttgctatatggtacaggttctaggtttgttatactgaaaatggctactgttcttgatcatatgatcttatatcatatacgtgcaaatcaggcctttaggccactggaatttcactatcgtttcatttaggaagagtagattgatccattatctggggcagcatagagaacacattgtctacctgcatagagatagtaccaaagtgaattatatgtgtttcatcacctttattaattctcccttctttttttagcttatt

SEQ ID NO: 6780 - DNA, 390 bp, Triticum aestivum
  Clone ID: LIB3281-044-P1-K1-B3
cggacgcgtgggcggacgcgtggggtaaaattcaaacaaatattttaggagctcatggatatttaatttttgacatatgttttgatttaattaaaatactaaatcattttattaccttatgccaatttttgcaggagctaactatattattccagagctccttaataaatggcatagtttttggaccatattttatatatataacaatatatatccaaagcaaataattatcggattaatccaaatggccaaaattaaatatccatgagcttctaaaatatttggttgaattttaccttttgccaatatttttgcatgagtacatgcatatttcctttttctctttttcgatacaatttttatttagtttgatcatttagagattatttt

SEQ ID NO: 6781 - DNA, 393 bp, Triticum aestivum
  Clone ID: LIB3281-044-P1-K1-B4
cggacgcgtgggtagtgacacttatttctattgtgccaaagtattcccaaaaagactggttatcaagctacgagtcacttgatacgtttgtggttccgagatcatcaaaaaagcttcacgaggacaatgagtatgctctctacactgtaacattatttgccaaggttgttgacaactttaaggtccatgctcgtgagaaaggtttccagatccatgactttgagtatagtcctgaagcacaggagagtcggaagcaagagctagaaaaactgctgcaagaccaggaagttatgaggacctctctattgcaatggtgctatgcaagctacagtgagtgctactcctagtggtcatcatggccgaacttaactgatgagagtatacctagaatat

SEQ ID NO: 6782 - DNA, 391 bp, Triticum aestivum
  Clone ID: LIB3281-044-P1-K1-B6
ataatttctataatttccaagaataggagtattgctggttaatcaattgatttacattaatatcttaaaaggggaccgcacgcatgtcctgatgctaaatctttttagaaaggaagggtttatgtaattttggtaggataaaaaatgtaaccttagtattacctagagctaggatatttgagtagattattttaatttttgtgctcatatgtgagatcatgataaaatttggaatatcatgttgctataacggaatcagtcgggatcgtgaagtctgcaccagaatgttgaccacccttttttgttttttaagttaaggaatgtacaacaagtctcttgcaaaaataactgtcctatccctttctacaatctctctatatctttgttagat

SEQ ID NO: 6783 - DNA, 381 bp, Triticum aestivum
  Clone ID: LIB3281-044-P1-K1-B9
cccacgcgtccgcccacgcgtccggtatacagtacacagccgctagctcttcccccgcggcgcccgatctcgtacttggagccttggaggagactcgaaccctaatcccctcccgcctcgatctctcccgccgaaggagagatcccgttcagcctcggctccaatccgcgactcgactcgactcgaagctccagctccgccgccgccccccgccgccgccgatggatccgaagctggtggaggtgacgcagctgttcgaccgcttcaaggcggccttcaaggccagcaatttcgacgtctgctcgaccctcctctcgcagctcaaggtcctcctcaccaagttccccagccttcccccgctgttccagcagacgcccaacg

SEQ ID NO: 6784 - DNA, 342 bp, Triticum aestivum
  Clone ID: LIB3281-044-P1-K1-C1
gcaagtggtctaaagtgggctcgggcagtatttatgctggccaacgagggggaggggtccaatcttgtgcggatccaactccataccatggtcgactgaagctacaacctggtgaaaacatcgggcgccaccatgggcgccccttttagtgaacggcttattagcgtgtgaacagttgtgataggagacgactaggtcacagcaagctatgacagggcatccacggcgttgtagcaagactgctagaccagcctagcacatgcgttgtttgatattcaccgaaatcatcccatggcttgcaagatgtgtttttatataaaaagttattccagagagcaccct

SEQ ID NO: 6785 - DNA, 388 bp, Triticum aestivum
  Clone ID: LIB3281-044-P1-K1-C11
caacacctctccttcccacatctcctcctcctgcctcatcactcatctccatccaccgatccacgacccatccatccatcagcgccaccagctccagcaccacaccactgaacgcccccgcgctgttgctctttctttcttccttcccagctgctttctgctgctccttcttcacctacctcgctactgctcctccacctctcttcttctcccaagatctgctcatgctgctttctctaatctcccacgcctttgttgttcttcttgcccaaaccttgttgctgctccttctctgaacatactgctgctactacgctcagctgcttcttctctgaccctactgctgctcctctccagcggccccttgctgctcttctccagcgctccc

SEQ ID NO: 6786 - DNA, 242 bp, Triticum aestivum
  Clone ID: LIB3281-044-P1-K1-C12
ggtgagccaccgtcgtcggcttcctcggctccgggttcggcaccgacggggagcgtagggcaggcgagcggcattttattgcccatgctcaacctcttcctcggcttagacaccaaggccgccgccgtgctgttcaaatgcatgatcatgggggcggctgcgtggtgggtctggtacaccctgctagtgtctgaccctaccaatgtggcgtcgttgcaagacttcatgctggtgctgttttt

SEQ ID NO: 6787 - DNA, 239 bp, Triticum aestivum
  Clone ID: LIB3281-044-P1-K1-C2
acagcagggcggccggaccacccaccgccgtctctccacgcccacacgacgccggagaaccttgcagcgccgaaccggtacaaactttaaatagctcctacgctcccctcccattccatccgccttctccccgaaaccctaaccgccgtcgctgccatggggggctcgcacagccggtaggaccacgacctcttcgacttcgacgactactacaccttctcccgcgccttcgacgcctt

SEQ ID NO: 6788 - DNA, 379 bp, Triticum aestivum
  Clone ID: LIB3281-044-P1-K1-C3
ctgaaacacaaggtgagatctacataggtcattgttcactttgatatcactaataattctaagcaaacttagctttgccaagtataccaatatacttgctacctgtaacaatgagacaggttattaaccactaatagtatgtgactgtttaacaaatttgtgttaatgtttcagtcccctccgtctcgctcctcgcccttatccccgtccctttccccttcctcccacccgcagccgacgaaactttccccacgcccctcggcggatcggaccgccgcgctccatccatgtcggaggaatctggtcgccctttgcccaagtttggcgaatgggacgtcaacgacccagcttctgctgatgggttcactgttatattcaa

SEQ ID NO: 6789 - DNA, 372 bp, Triticum aestivum
  unsure (1)...(372): unsure at all n locations
  Clone ID: LIB3281-044-P1-K1-C4
ttcaattgtgcattctaaaaatgttcggtgtgtattagaatttttttcaccctatagtaaaaaaagatcctcatatattaaaaataccaattttctataaatatttgttcgaatatacaaaatttctattttatatttgaaatttatttggtgtgtatattaaaaattgttgctgtatattaactaatgttcaatgtatattatagaaagttcaaaaaaaaaaaaaacacaaaaaacacaaaaactatacaaaaacccctcaggnggaacggaccgccgcgctccatccatgtcggaggaatctggtcgccctttgcccaagtctggcgaatgggacgtcaacgacccagcttctgcttgtgggttcactgt

SEQ ID NO: 6790 - DNA, 393 bp, Triticum aestivum
  Clone ID: LIB3281-044-P1-K1-C5
gcaacaagtgttaagttattggttttgttccatggtgggtagctgggcctcatatatgcaaaatatttgggcagacgggaggctgcggcaacccttcttcacctctgtgcagttcggccacgaagaagaaagaatacaggcagcaagtcagtcagtcagtcagtcagttccagtgttgtttcattgtccagccagccagcgattctttatttgttgaccttgatttgaatggagaggataaaatgtatgtaagtgagccgaaactgagagctgtcgtctgtaatgctatgcccgaaggatgtattattatgtatgtacaaactgaaaacaacttgtattttctctctgtaaggcaagaatgccgtttgtaatagaggaagctgcacattattt

SEQ ID NO: 6791 - DNA, 362 bp, Triticum aestivum
  Clone ID: LIB3281-044-P1-K1-C6
ggaaggagataaatatgaatgcaatgggattgttggtttcttctacagacaacacacgcactctgactgggcagccgggtggctgtccaagcccttcttcacctatgcgcagttcggacacgaagaagaaagaatacaggcagcaagtcagtcagtcagtcagtcagttccagtagttgtttcatcgtgcaaccagccagcgattcttaatttgttgaccttgatttgaatggagaggataaaatgtatgtaagtgagccagaactgagagctgtcggctgtaatgctatgcccgcaggatgtattattatgtgatgccaaactgaaaacaactcgtattttctctctgtaaggcaagaacg

SEQ ID NO: 6792 - DNA, 387 bp, Triticum aestivum
  Clone ID: LIB3281-044-P1-K1-C7
cccacgcgtccggtcttccccagatctccgccgcacacgctccggctccgctccccctcccctccgctcctctcccaaatttcaaattctcctacgctcccctcccattccatccgcctcctccccgaaaccctaaccgccgccgctgccatggggggctcgcacagccgggaggaccacgacctctccgactccgacgacgacgacacctcctcccgcgccttcgacgcctcctccgacttctccacccctccccccgcctccgcctccaaagccgccagattggcgaccccggcctccgtcgtcgacgacatcgaccaccaccttcgcaacctccaactcaagtactccgagcccatctccccgaaccctagccccgcccccaac

SEQ ID NO: 6793 - DNA, 386 bp, Triticum aestivum
  Clone ID: LIB3281-044-P1-K1-C8
ctctcctgccaatcccctcatcgcctccgctcccacgccgccgaatccgagacctgatctcggattcaccgcagcgacgcgaccaaaccctcaggcgatccccggcacctcctccccgacgcttcagccatggcaggaatggcaccggaaggttcccagtttgatgctaagaactatgattctaagatgcaggagctgctgagccaaggtgagactgaggagttcttcacctcctatgatgaagttcatgagagctttgatgacatgggtctccaagagaacctcctcagaggaatttatgcttatggttttgagaagccttctgccatccagcaaaggggaatcgttcctttctgcaaggggcttgatgttatccagcaagcaca

SEQ ID NO: 6794 - DNA, 359 bp, Triticum aestivum
  Clone ID: LIB3281-044-P1-K1-C9
cggacgcgtggggcctcaaccccccttgattattccctcgaaaccctagatccccaaacccacgcggccacctcctcatggatcatccatggcgcttcccagccggcgccggcaacgacctctgccccgtctgcaccgcgccccacttccccttttgcccgcctccgcctctcccgccccacccctttccctacgatctccacccaccgctccctcctcccccgccgcagtaccatgcccccttccacccgccgccgtcgtcgccgccgatgtgggctcctccggggccgcacccgtacgatcttctcgacacgggaggcccccacaagaggatgcgcgtgggggaggcgccttcggtt

SEQ ID NO: 6795 - DNA, 322 bp, Triticum aestivum
  Clone ID: LIB3281-044-P1-K1-D1
atccggggcggaccacgcgtccgtccttttggaagaggggatcctcttaaattggttaggtgtcacttgagagccttcgatttggtgtggagttgaaccaagaagtttgtaagggcaaggagatcgcctacttcgtgaagatctacccgagtgaggcaagttcttcgtgggcgatggccatggtgggatagacaaggttgcttcttcgtggacccttcgtgggtggagcccttcgtagactcctgcaaccgttacctttcatgggtagaaatctccatcaacgtggacgtacgatagcaccacctatcggaaccacgccaaa

SEQ ID NO: 6796 - DNA, 393 bp, Triticum aestivum
  Clone ID: LIB3281-044-P1-K1-D10
tcggcagtctccagagatgacaccattagtatgggtcagttgcattggtgacgctgagcacaaagctatgaatccactcccttttgctctggactgtgtttggttatggcgtaaactggctatctcgacaacatttatgctgaagttatcgaccctccaaagaatgggatgttagatgtcatagaacttgtctgtggtgttatcaagcattcacggaatccaaatgtcatggtttctagaaatgggcgtgagctattggaatgccccatgtgtttggttcccatgtatcctccaattcatcagtgctccaatgtccatgctatttgttctgaatgcaagccaagggttcataaatgctttggagaaggttggcgcctctctagaggttctgta

SEQ ID NO: 6797 - DNA, 335 bp, Triticum aestivum
  Clone ID: LIB3281-044-P1-K1-D11
gcagcctccagagatgacaccattagtatgggtcagttgcatgggtgacgctgagcacaaagctatgaatccactcccttttgctctggactgtgtacggttatggcgaaaactggctatctcgacaacatttatgctgaagctatcgaccctacaaagaatgggatgttagatgtcatacaacttgtctgtggtgttatcaagcattcacggaatccaaatgtcatggtttctagaaatgggcgtgagctattgaaatgccccatgtgtttggttcccatgtctcctcacaattcatcagtgcttcaaagttcatgctatttgtcctgaatgca

SEQ ID NO: 6798 - DNA, 395 bp, Triticum aestivum
  Clone ID: LIB3281-044-P1-K1-D12
caaccaatctctcctcgccgccacactccccactcccactgcttcgtcgagccagctcgccaaccagagaagatgagggagatcctgcacatccagggtggacagtgtggaaaccagattggttccaagttctgggaggtggtgtgtgatgagcatggcatcgaccccaccgggcggtatgtcggcacctctgacctgcagctggagcgcgtcaacgtctactacaatgaggcctcctgtggtcgctttgtgccccgagctgtccttatggatcttgagcctggtactatggacagtgtccgtactggaccgtacgggcagatcttccgccctgacaactttgtgtttgggcagtctggtgctggtaacaactgggccaagggtcactacaccgt

SEQ ID NO: 6799 - DNA, 94 bp, Triticum aestivum
  Clone ID: LIB3281-044-P1-K1-D2
ctccctcgtaatagtagattcttttagaatccatactcgttcctttacagcatggggttttttctagagcagaaccacacttcctgttctggca

SEQ ID NO: 6800 - DNA, 365 bp, Triticum aestivum
  Clone ID: LIB3281-044-P1-K1-D3
cggacgcgtgggggatctttgacgagtactcaaaattccatggtcactccccagctgttgtcacagggaagcccatagatcttggtggatcattaggtagggatgctgccactgggcggggtgtaatgtacgctactgaagctctcctggccaaatatgggaagtctatttctggatcaacctttgttattcagggattcggtaatgttggttcatgggctgcacaactcattcatgataaaggtggtaaggtaattgcacttggagatgtatcatgcacaatcagaaacaaagcagggatagacgtacctgctctgatgaagcacataaatgatggtggtcagttgtaaagatttttatggcgc

SEQ ID NO: 6801 - DNA, 327 bp, Triticum aestivum
  Clone ID: LIB3281-044-P1-K1-D4
ctaggggcttcgcagagctcgcggaaatggtggccttcaggttccatcagtaccaggtggtgggtcgcgcgctgccgacgcccggcgatgagcagcctaagatctaccgcatgaagctctgggccaccaatgaggtgcgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcagaaccggctaccacaacatgtacaaggagtaccgtgacaccacac

SEQ ID NO: 6802 - DNA, 69 bp, Triticum aestivum
  Clone ID: LIB3281-044-P1-K1-D5
cccgcaaccgtccgtggacctgctcccgggcgagtgcctattcgaggacctgctccgcctgcccggagc

SEQ ID NO: 6803 - DNA, 380 bp, Triticum aestivum
  Clone ID: LIB3281-044-P1-K1-D6
cacaatttactccagcccccctaccaccgcactcgaaaacctctctctctctcactccaacagtttgcaggaaagagagggagagatcgatcttgcgttgccaagatgttcatcgagagcttccgcgtggagagcccgaacgtgcggtacggcgcgggggagatcgagtcggagtaccgctacgacaccacggagctggtgcacgagagccacgacggcgcctccaagtgggtcgtccgccccaagtccgtcaactaccacttcaagaccaacaccaccgtccccaagctcggggtgatgctcgtggggtggggcggcaacaatggctccacactcatggctggggtcatcgccaacagggaggggatctcatgggcgac

SEQ ID NO: 6804 - DNA, 379 bp, Triticum aestivum
  Clone ID: LIB3281-044-P1-K1-D7
aacacaccagagctcacctctcccctcgcttcctcgcgaaaatgtcgactgaagtggctgccgctgacatcccggtgcctcaggtggaggtagccgccgacgccgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcacctcccggccaacttccgcaagatcctgctgacccagatcaagaagcttgtcgccgtcggcaagctgac

SEQ ID NO: 6805 - DNA, 390 bp, Triticum aestivum
  Clone ID: LIB3281-044-P1-K1-D8
cactggttaatgacacagtcggcacattggctggtgggagatatatggataatgatgtggttgctgctgtaatattgggcactggtacaaacgcagcatatgttgagcatgctaatgcaattcctaagtggactggactactgccaaaatccggaaatatggtaatcaacacggaatggggaagctttaaatcggacaagcttccactttcagaatacgacaaagcattggactttgaaagtttgaaccctggagaacagatctatgaaaagttgatttccggcatgtatcttggagagattgtgcgaagaatcttactgaaactggctcatgatgctgcattagttgaagatgttagttcagctaagctggaactgccattcgtactta

SEQ ID NO: 6806 - DNA, 391 bp, Triticum aestivum
  Clone ID: LIB3281-044-P1-K1-D9
cggacgcgtggggctctatgaacatggctcggccgctgccatcactgtgaaccgcatgttgttcctcagatgcaacaagaatgacttcttgggttcactgtactttctaaatggttgtaacttttttgcttctgaagtgtcacaggataccaaaaatctcgatgatatattagtcacctgcagtccttgacaagaattgatccaaaggacgaagacttataaagtcctcaagctcataaactacaggaagttggaagcagagaaaatggattgggacaaggagccagacagaggatgaggaggggctcagcggaacaaatggccaaggagaaaaaaatagctatcgccacaagcatcaagatatgtgggcttcatgtaagagtgaacaaca

SEQ ID NO: 6807 - DNA, 391 bp, Triticum aestivum
  Clone ID: LIB3281-044-P1-K1-E10
cggacgcgtggggcttctcatatctttcaagagggcaactggacagaaacctcagagaatcatattttacagggatggtgtcagtgagggacagttctatcaagttctgttgtttgaacttgatgccattcgtaaggcctgtgcatccttggagcccaattatcagcctccagttacctttgtggttgtccagaagcgtcatcacaccaggcttttcgctaacaatcacaatgatcagcgtactgttgatagaagcgggaacatactgcctggcaccgttgttgactcgaagatctgccatccgacagaattcgatttctacttgtgcagccatgctggcattcaaggaacaagccggcctgctcattatcatgttctgtgggacgagaac

SEQ ID NO: 6808 - DNA, 363 bp, Triticum aestivum
  Clone ID: LIB3281-044-P1-K1-E11
cccacgcgtccgcggacgcgtgggttagtatcacaggtttatactaattttccaaccaggagaactccagttctgaaaggtttatactcaccggtgagctattcccagtagaaattactggataggagcaaaattgtttttcaagatcatgttagtattttttttataatagagccataggctacaccaaacaaattggattgttttgatttcattgtgtggttgtgcttgcgatccaggtgagttgagctgcggcttggatggggatgttggtgctgttcaagaggcctgctgggtttgcctttttcaaggttctgaaccagggcaggatctatggaagaagttcacgactcggactcgacg

SEQ ID NO: 6809 - DNA, 349 bp, Triticum aestivum
  Clone ID: LIB3281-044-P1-K1-E12
gacatgatctaacaatgttttacgcttcaatgaccaaacacaagtctcgttcagacttacacacgatgtattgaaaaataaggtaacatcaggcataagcaatgttaggtactcgtactaataacagattgccgacattattttggactctaaaagactcgcagataaattggttctgggaaggtctcagactactcaaggtgaggtagcttctctcggaaaacaccgctacttgttgtaaaaagaaattccttagatacagcactatcctgcacttggttggctgcccctccctccctcctacatcgcgggatggaaccccgcggattgcaagagaaccgtcttgatc

SEQ ID NO: 6810 - DNA, 401 bp, Triticum aestivum
  unsure (1)...(401): unsure at all n locations
  Clone ID: LIB3281-044-P1-K1-E2
cggacgcgtggggtctagacgacttaagtatacctcattcttccacaatatcaatgcgagttcacttcgaactgcaaagatgatgtgtccagatccatttgatgatcttttgaagactgtgataatgaatgatcagctagcttgtgatcctgatgttggcggttgcggaaaaccaaatcatatacaccacattctttctagttcccctcatgtttttacagttgttttgggatggcagaacagcaaagaaagtgttggtgacatagctgcaaccttggctggtatttcaactgagattgacatcagtgttttctaccgtggtctagatcaaggaagcaaacattntctggtgtcagtggtttgttactacgggcagcattatcattgctttgctttcgagg

SEQ ID NO: 6811 - DNA, 401 bp, Triticum aestivum
  Clone ID: LIB3281-044-P1-K1-E3
cccacgcgtccgcggacgcgtggggttttttttgggtacttcaatatggactacatacgggctgaaatgtttgaaatcttatattttgtgaatggaggttgtatatttttataaaagcaaagaaacaacttgcataagtgcaccctgtgttaggattaacttgattttaatcttgaaatactgaatgatcggcgatgtaatttcatgtttgcttcaaaatgaggcatcaaagatgaataactctggaatgccaccttttctcatgtatttttccctcaagaaaaagtagtatgaaaatactgattgatccctcttcatcttttcgatgttcttttgcatcttatcaaaaatatgtgcaagtcttcaggggtcaattaatgtttgtaattggctacattaag

SEQ ID NO: 6812 - DNA, 397 bp, Triticum aestivum
  Clone ID: LIB3281-044-P1-K1-E4
atttctctcctcctcctcctgccaccgatcccgaaccagggaggaacccggcgcgaggagggcaaaggaagagaagaggagatcaccgagcccagcgcgcgcacaggacagcaggcgccgtgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactactttcagaacaccc

SEQ ID NO: 6813 - DNA, 288 bp, Triticum aestivum
  Clone ID: LIB3281-044-P1-K1-E5
accacgcttgcgcggacgcgtggacgcttccaagcggagcctcaaggagctgaagggcctgcaaagaggatccccccacctgctgcagcgccagccctgtggcggaagatatgtttcactgatacacgacaatgatgggttcattgggaagcccatatgctggtggtgtatactcggatactattcacttgcccccagactacccattcaagccaccgaaagctgcatttaaaacacaagtttctcacccaaaaatccacagcaatgggagcatctgtcttgatatct

SEQ ID NO: 6814 - DNA, 369 bp, Triticum aestivum
  Clone ID: LIB3281-044-P1-K1-E6
cggacgcgtgggcgcgaaggcgatgctagctcccgcgctgagcccccccaaaagatttggcgacgcgtcgcccaccccaaacgggaacctcccccccttactgaacccccttgcaatccgcaaatccacgatagccctagggcgtgcagcgctggaggagcggcactcgtaaccctacccgcctgccatggtgatcgctcgaggagggagctccgtgcaccaggacgagggggaggacggtgaccaccccatgcgctacctccctcgtagccgcgtttactttttcaccgaccgatgctcgccccccaagaagccccgtagcttcgtcttcgtcgtcgagggcgccaagccgtccgtgatcgtctacta

SEQ ID NO: 6815 - DNA, 373 bp, Triticum aestivum
  Clone ID: LIB3281-044-P1-K1-E7
gtggaaagtagcggctcgcaatcgtggtcagggaccgaccgtccgagagtagaccgtggagacgtggagacattgcagtcacgtagattttgctggttgtggcattgcttgaaattggattattggatagctggagctgcgtaggatttcttctaatttactccaggagaccaagaccaagcttcatgaattcagggcgccgcccaggtggtcatgtgggatcctctcgaacagcccgtgctcgctgtcgacttcgatggcagggtcacccgctccatcggctccctctccggcgggatgtactagtcagatttcatcccctacgtcaactcatacacagagatctacatattggccaagtgttcgtcgatct

SEQ ID NO: 6816 - DNA, 285 bp, Triticum aestivum
  Clone ID: LIB3281-044-P1-K1-E8
tcgcccacgcgtccgccaacgcgtccgcctaatccacctttttccccggccggccccaatccacttttttaaaccgtgggaacggcccaaccggaatccggcttcttcccgtcggcgccgagtggccacactcaggcctaagtgtcggctgcctgccgggccctccaagcgacccatggccacataaagcgttcggccactttcggctactcctcgtttgcacgggcggccggcaaggacgcgcttgactttgctgcatcgagcgagcactctcccgacgccagg

SEQ ID NO: 6817 - DNA, 396 bp, Triticum aestivum
  unsure (1)...(396): unsure at all n locations
  Clone ID: LIB3281-044-P1-K1-E9
cggacgcgtgggcggacgcgtggggcgtggacactgattacttatttctcttggagggttactaaaatgcggtgtctaccttgtgttggaaaaacttgaactctaggtctaccggagattagttaagaaaatgtgagtgtaaacttgaaggtctccttgtcacaattttacagaatgaaccaatccttttcgatttgctttcttctgcatgcatatcatccagagggagaaggaaccatcgtctaaggtgcatcaaatcaagctagaggtttctgcatccattttagtcgagtagcagtcttgcgaaaggtgaccatggcaaacattntatcctgttacaagcacgttatttggatgaaatggtgtttattgttggtggcttatttgtatgcctaa

SEQ ID NO: 6818 - DNA, 375 bp, Triticum aestivum
  Clone ID: LIB3281-044-P1-K1-F1
aggaaatccatgcctacctgacaagagtaatgtacaacaggcgcaataagtttgaccctctatggaactccctggtgcttggtggagtgaaaaagggcccaaagggcgatgagaagtatcttggcatggttaacatgattggtacacactttgaggagaaccacattgccactggatttgggaaccatatggcaatcccaatacttcgtggtgaatggcgcgaggacatgacttttgaagaagccgttaagctgattgagaagtgcttgctggtcctgctgtaccgtgaccggtcatccatcaacaaattccagattgccaagatcacgaccgagggatcaaccatctacccgtcgtatgctctgaagaccaact

SEQ ID NO: 6819 - DNA, 244 bp, Triticum aestivum
  Clone ID: LIB3281-044-P1-K1-F11
gtcacgcatccggacatgcatcttggcgggcgtcggtgttgatagagagggtccgctctagaggctgcaatcttgcgtacgcgtgcatgcaagctataagatatttaatagagtgagttaaataaatttcattggccgtctgtttacaaaggtgggactgataaaaacatcgcggggcctaccttaatgaacttaaaggacatgcatcattcttgagctggcgtaattatgaataggcttgaac

SEQ ID NO: 6820 - DNA, 148 bp, Triticum aestivum
  Clone ID: LIB3281-044-P1-K1-F2
aggaaacgtatgcctacctgagaagagtattgcacaacaggcgcaataagttagagcctctatggaacgaggtggtgctttgtggtttgaaaatggatccaaaggtctattaaaaattgcttgaactggttaacatgattggtacaca

SEQ ID NO: 6821 - DNA, 362 bp, Triticum aestivum
  Clone ID: LIB3281-044-P1-K1-F4
cttccccgcacgagttcgcacgcgcatcctcgcagccggcgcccccatcccgtggccttcttcgctgccggcgtaccccatccagccgctttcttcgccgccggcacgccctatcccgccgtctccttcatcatcggcgcgccccatcctgcgcccttcttcgctgccggcgcgccccatcacgcggcccttctgcgccgccggcgcgccccatcccgccgccttcttcgtcgtcggcgtgcccttcttgcggccttcgccaccacctcccgtcccactccaccctccctcgttcctccacctccttgccccgatccagaccgcccagaccccgacgccttcaccaacggcgcgcgcggacc

SEQ ID NO: 6822 - DNA, 376 bp, Triticum aestivum
  unsure (1)...(376): unsure at all n locations
  Clone ID: LIB3281-044-P1-K1-F5
cggacgcgtgggtgggacgaaaaaaaacctgggaggtgggagttgtccctggttaacctacaaatttcgtagatttttttaggacgaaaaaaacccgtggaaggtgggactaaaaaaacctggaagcgagactaccaactgctcccttaggagtagagattcatgggatcaccaacttttggcgtttgttgatactagctatgtggggccatgaattcctagaagattgtggcaattatcctgcttcgcttgcaagattggtttctaaaaatatcatggtagttataatttcagattgctgctgatttgactaaatatgttttgattgtttttaagctttgactctntactgtgtgcacaactaattcatttctaa

SEQ ID NO: 6823 - DNA, 404 bp, Triticum aestivum
  Clone ID: LIB3281-044-P1-K1-F6
cagcacccgccgcccgtccacatcccttcacatcggtcgacccagatctcacaggccgcccaagccagccagcgacgatgaggccctcagtgatgagatccgccgcccagctcctccgccgccgcaactactcctccgcgtccgggcagcaggcgcggaaggtggccatcctcggcgcggccggcggcatcgggcagccgctgtctctcctcatgaagctgaaccccctcgtctcctccctctccctctacgatatcgcggccaccccgggcgtcgctgccgacgtttcccacatcaattcccctgccctggtgaagggcttcatggcggacgatcagctcgcggaggcgttggatggggccgacctggtgatcatcccggccggcgtcccgaggaagcccggc

SEQ ID NO: 6824 - DNA, 369 bp, Triticum aestivum
  Clone ID: LIB3281-044-P1-K1-F7
ggatgctttgcccagactttgggtgttttgtttgcagaagcaaaatccctccgtgttattcttttgtctggtgcatcttataggtatgttgtggaggatgtgtttcgcagtcttccaagacttattcatcttcgttacctaaggataacgccttttgcaagactaaacagcaacatctcaagattttatcacctgagggttctagatgttgaacaatacagtgtccaactagattttccaagagatatgagcaaccttacaaaactgcgccattttcttgtccgagacattgacctgcagtatataaattctgacgttggaaaactggaattattacaagacttaagaagctttatggttaaaagggaa

SEQ ID NO: 6825 - DNA, 279 bp, Triticum aestivum
  Clone ID: LIB3281-044-P1-K1-F8
cgcacagcaggaagagaggccaggtagctagctagcttggtagcttggtaaccatggcgaagaaggcggcggtgatcgccacgctgctggccctgaacctgctcttcttcaccttcgccgacgcctgcggctgccactgcggatcctgccctagtccgggcggcggcggcggcggtgggggtggcggtggaggtgggagcggtggcgggggtggtggagggagcggcagtggctgatctagaagaggcggccgcggctgcagtgggtcacgaggaggtg

SEQ ID NO: 6826 - DNA, 397 bp, Triticum aestivum
  Clone ID: LIB3281-044-P1-K1-F9
cggacgcgtgggcagaaacagaactacgagctcctcgccctcgcctcccccgctccactccgattcctcctcctccgccgccgccgccgttcgatctccggggctccggtcccaagctcccggcattctccgcgaggaattgctatggaatgcttgactgcgagtttcgccgcgaggaatgcgggtagggattataacttcgtatgtccgagtaagcccgcgggcgagaagcaatggattcaaggaagggttctctgctattttacagcttacacaaactctagccgatgctgcaaggttgccactggggtgtaccccatcagcccagttgttggcagacgttcacgctggagatctttcgcagcaagtttgaatttagagaatgggcctgcaccat

SEQ ID NO: 6827 - DNA, 393 bp, Triticum aestivum
  Clone ID: LIB3281-044-P1-K1-G1
ctcgagccggttacgatttcctctcttcgccttcctcccctgccggcccctccaaaccctaggcgccgccggccaggaagtccatttaccagccatgtttggacgcatgccaaggaagaccagcaacaacaccaagtactatgaggtgcttggtgtatccaagacagcaaccccggatgagttgaagaaagcttaccggaaagctgctataaaaaaccatcctgataagggcggagaccctgagaagtttaaagaattggcacaagcttatgatgttctcaatgaccctgaaaagagggagatttatgaccaatatggagaagatgcaatcaaagaagggatgggaggcagcggcggcgctgatatgcatagcccctttgacatattcgaaca

SEQ ID NO: 6828 - DNA, 148 bp, Triticum aestivum
  Clone ID: LIB3281-044-P1-K1-G11
gtgcaatatcttgtttgtgtcagcgtgtcagataccttaaatatcatatcgtgtttgttctagttggatgtttcagagatgcttatgcagagtttgttaaaacatttatattatgcttttgaacctagactactcattctgtgcgtgc

SEQ ID NO: 6829 - DNA, 384 bp, Triticum aestivum
  Clone ID: LIB3281-044-P1-K1-G12
cagacgcgtgggcttcaagaggccagaaccaaccacagagaaacatacattctcctggaataaaccggagcaggagcggtagataggcatgagagatcaggacaatagttcgtcaagagcaccctcgtgctaagaaccaagggatccgtccgtgttatcactgtcgctacctctcctgtaacctcggaatcctaaacatgaccaaattcaagtaggaagcagctgttcatcactgacgacatgtaggtgcagctggttgaccccgtagatttataatgtacctgttatatgcccatgctgttctgtagattgtgacttgaaacttaaaaaaccgtacccccatgtgtgagctgaaccttattttttgcttggtgaaaaataata

SEQ ID NO: 6830 - DNA, 319 bp, Triticum aestivum
  Clone ID: LIB3281-044-P1-K1-G2
cccacgcgtccgggagcctgaggaggacatgtaaggtgggaggtccatgtggtgctttgctgggtgggggggttctgggggcagagtttgatctgtttggtgctttgttataaatctgtttatcatcgcaactaccgcttgtacgccaccgccattcttcatgcctttcctaagctttgtatttctcatgttatggcaccttttcggtattgtatcacttgatgccatccggtatgttctgtgttgaggtttctggacctctatagtatataatggcttctgagttgatttttcatgcataatgatttcgtcagactgt

SEQ ID NO: 6831 - DNA, 194 bp, Triticum aestivum
  Clone ID: LIB3281-044-P1-K1-G4
ctcacccgcacgagttcgtacgctcattctctcagtcggcgcccccatgccgtgggctttttcgctgacggggtaccccatccatccttttttttagccggcggcacgccctatcccgccggttacttgatcatcggcgcaccccattctgcgctcttttattctgtcggcgcgccctatcacgcggtcctttt

SEQ ID NO: 6832 - DNA, 393 bp, Triticum aestivum
  Clone ID: LIB3281-044-P1-K1-G5
gggcaaccggctaactccaccaatgccgccgctgctcaccctctcctcctcgccggtgctgccgcccagggcccggttcaaggtctcggcctccgccgacgtcggcgccaccggccgagccgccgccgcctccaacggcttcccgccgttcctgcccagggcggtcgagcgcatccgcgacggcgccgccctccgcctcgccaagcgaatcgagcgcgtgcccgtccagaccggcttctcgaagagcccgataccgagcagctgcgtgaggccactcaagcagcagcagagcgccgatccggtcgtgctgctccacggcttcgacagttcttgtttagagtggaggtacacctaccctttgctggaagatgctgggctggaaacttggggctg

SEQ ID NO: 6833 - DNA, 250 bp, Triticum aestivum
  Clone ID: LIB3281-044-P1-K1-G6
gcgaagcgtgctaactccactaatgccgcgcgtgctcaccctctcctactcgccggtgctgccgcccagggcccggttcaaggtctcggcctccgccgacgttggcgccaccggacgagccgccgccgcctccaacggtttactgctgttcctgcccagggcggtcgagcgcatcctagacaggagcctgccttcgcctagccaagctaatacagcgcagtacccttctcagaccgtcttctctaagagc

SEQ ID NO: 6834 - DNA, 393 bp, Triticum aestivum
  Clone ID: LIB3281-044-P1-K1-G7
acaaatggtgccgtcttgtgaatcagctggagctgctctccttcttcctaatcgagctcagcctcgtcgactacaagatgctcaagttccagccgtcgatgctggcggcggcggccatctacaccgcgcaatgcacgctcaacgggtgcatgtcctggaacaagtgctgtgagctgcacacaaaatactctgaagaacagctcatgtatggaaacacaccactgtctttcattcagaccaaccaactttcagtgagtgatgtgatatgcctttgttactcacacggctgtttggctcacttgttttgcagggactgcagcacgatgttggtggagctgcaccagggcgcggcgcgcgggaagctcaccggggtgcaccgcaagtacagcacct

SEQ ID NO: 6835 - DNA, 392 bp, Triticum aestivum
  Clone ID: LIB3281-044-P1-K1-G8
gttgcggagaagcaaccatttgaacgcattgaagtctccagagcagaagctcttgaagtttttgcggaaaatgaatttaaggttgaaataattaacgaattgcccgaggacaagaccattacagtatacagatgtggtcctttggtcgacctctgccgtggcccgcacatcccaaatacttcctttgttaaagctttcgcttgcctcaaggcttcagcatcatactggagaggaaaagcagaccgtgagagcctgcagagagtatatggaatctccttccctgattctaaacgtctcaaggaatatcaacatatgatagaggaagctaagaaacgcgatcataggttactagggcagtcccagaaactcttttttttccatccacttagccc

SEQ ID NO: 6836 - DNA, 384 bp, Triticum aestivum
  Clone ID: LIB3281-044-P1-K1-G9
cccacgcgttcgcccacgcgtccgatcacaccctcctgctcctcccggcaacctccaaccaacctctcgatcgatcgtagcggcttctgctttttcgctcgcggcgataggcggtggatctgaccccgaggcagccggtcaaggcctacggcggcgacggcggcgcctactacgagtggagccccgccgagctgcccatgctcggcgtcgccttcatcggcgccgccaagctctcgctcgccgccgccggcatgtcgctccccagctactccgactacggcaaggtcgcctacgtcctccaaggcaaaggaaccgttggcatcatcctgcctgaggccaccaaggagaatgtggtcgccgtgaaagaaggcgatgctctggcgc

SEQ ID NO: 6837 - DNA, 396 bp, Triticum aestivum
  Clone ID: LIB3281-044-P1-K1-H1
agggtgggcaccaccagaccggaagccgtgtgctggttgggttagtgcattcgaggaaacctagcaatacgctaataatcctactgaaatgtggtgaagccagctcacaaaggagcgagagtgcaagagcatgctgaagacatacatgcgacaagcagtccaatgcacactttctcgaggcagtacacgagacttcaatttgaccgttagtcgggcaacaagtatgagaaggaaatgacaaggattctaagttttttttttggttttaatttgtttggtcataaaactgaaaatggtagactaattactaatgtgaatgtgtgtcttattaacagagtggagtggtgccatagagcagcacgcaagcaagggtgggggtcgggtcaaggctgttgt

SEQ ID NO: 6838 - DNA, 392 bp, Triticum aestivum
  Clone ID: LIB3281-044-P1-K1-H10
ggttcctgttaacatccacagaaacctgaattttctcctagaggcctgcttaccatctggtgatatcattgcacaaaaagtattgtcctttgaacccaaactttgcaacataagtcagggtagttgtgaacttaatggtattgagttggagatcactgttgcttggtcttgtcttgtttctgagaagcgggatatttcggtacaaggatgtgttggtgatgaggagcaggacggggacattgcatcaatggagcagcaggtgccgaagatagactccaaattgacatcggaggtggggcccgaggcggagacggagtcggcgatgagtctggataccagtgaattggcgaatgaatcgagtacctccatgttcatatcagacaagtcaatac

SEQ ID NO: 6839 - DNA, 377 bp, Triticum aestivum
  unsure (1)...(377): unsure at all n locations
  Clone ID: LIB3281-044-P1-K1-H11
ggatgcacccacgcgcgcgtggtcgcgtgggaaaggcgtccagcttaacccccactcgttaggagcatctccgacaggacaacggccaacccctctctgtctctctctctctctctctctcctcgccgcgcctccggccccgccgccatgaacaacctactcaccgattccttagagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagactgcanacgaggaatcaaaagcagttacaaaagcaagtgccatgaaagc

SEQ ID NO: 6840 - DNA, 277 bp, Triticum aestivum
  Clone ID: LIB3281-044-P1-K1-H12
tcacgcgtccgttgtctcgttccagagcccgccgtcacacctgcatcgcgctcgatcccatcacccgctcgacctctttattcgtcctgatcgagaacagaagcgcctccgagccctcgtgcccatgaacgtactccgccggccgactctgttcaccgatgtccgtcaccgcggtaccttgcatcgcatagctgctgtgctcccatgccgggcgccacccaagccactcactgcttgcgccaccctacatcgtcgagctagggccggtctcagacat

SEQ ID NO: 6841 - DNA, 335 bp, Triticum aestivum
  Clone ID: LIB3281-044-P1-K1-H2
agggtgtgcaccaccagaccggaagccgtgtgctggttgggttagtgcattcgaggaaacctagcaatacgctaataatcctactgaaatgtggtgaagccagctcacaatggatcgagagtgcaagagcatgctgaagacatacatgcgacaagcagtccaatgcacactttcttgaggcagtacacgagacttcaatttgaccgattgtcggtcaacacgtgtgagaaggaaatgacaaggattctaagtcttttttttggttctaatcggtctggtcataaaactgaatatgggagacttatttactatgtgaatgtgtgtttttattaaca

SEQ ID NO: 6842 - DNA, 324 bp, Triticum aestivum
  Clone ID: LIB3281-044-P1-K1-H3
gctttccctttctttacacccaagcaagctccctacctccctccccgagggccagcggcgagcccggacccgtagatcggctcgagctccctctctatccagaaccgcagcggaggccgcctcttactgaggcagcctcaaagcgaaccggagcttatcaggctccggagcagcgtgtcgaccgcaggcggatgatgatggacgccgtcgctgtcggcacgagcatcagctgatccggggcccatggggacgccgccaggcagaacaacaccaggatgctcaagtattccaagttcacgcattaagagctgccggactgcaaag

SEQ ID NO: 6843 - DNA, 375 bp, Triticum aestivum
  unsure (1)...(375): unsure at all n locations
  Clone ID: LIB3281-044-P1-K1-H5
gggacgcgtgggtttgttccgaagttttttagatccaacggcgaggcacgaccccgcatctaccccgccggcgaccatcagggccggccaaccgcgccgtcccgccccgcggccccattcctccgtagatcctcgccgccccggccgccggccgcgcctatatgaccgtccncggttcgccggtttctcccggtgcaagcaagatgagcagcgtcccgtggaagcggctggagctcgccgcgctgtgcgcctacgcggtggtgttctacagcgccatggtccagaggtcgcttcgcctcgcccgcgatacaccgggaaactctacgcctaagactggatcaatcccggcgtctgaacgtgtgactgttgacgcgc

SEQ ID NO: 6844 - DNA, 326 bp, Triticum aestivum
  Clone ID: LIB3281-044-P1-K1-H6
cggacgcgtgggtggccgaggacaagcccttgcccatgtacgatgagttgtccagcaaggacaatgttgaatatattgctggaggagccacccaaaactctatcagggttgcccaatggatgcttcaaactcctggtgcaacaagttacatgggttgcattggaaaggacaagtatggtgaggagatgaagagcgccgctaaagctgcaggagttactgctcattactatgaggatgaggctgctcctacaggcacatgtgctgtctgagttgtaggaggcaaaaagtcattgattgcaaacttatctgctgcgaactgctacaaa

SEQ ID NO: 6845 - DNA, 394 bp, Triticum aestivum
  Clone ID: LIB3281-044-P1-K1-H7
cggacgcgtgggctttagagttgtctgctgttattgcttccatggcaacaaatgagaacctcccaccaaatgtcatcaggcaattggctaaagaactgaagaatcttgatgaatcacctccggaagggattaaagttattgttaatgatgatgacttcagcaccatttttgctgatattgagggccctgctggtactccatatgagaatggagtattccggatgaagctattgttgtcccgtgacttccctcactctcccccgaaaggattcttctcgacaaaaatattccatccaaacatagcaactagtggcgagatatgtgtgaacacgttgaaaaaagactggaaccctagtcttggattgagacatgttctgctggtagtgagatgcct

SEQ ID NO: 6846 - DNA, 290 bp, Triticum aestivum
  Clone ID: LIB3281-044-P1-K1-H8
accagatcgtggagcagctctgcccggggctcaaggacgaggtgatgaagatcaccctcgtgcagaagcagacccgcgccggccagcggacccgcttcaaggcgttcgtcgtcgtcggcgacagcaacggccacgtcgggctcggcgttaagtgcgccaaggaggtggccacggccatccgcggcgccatcatcctcgcaaagctttccatcgtgcccgttaggaggggctactgggggaacaagatcgtgctgctccacaccgtgccctgcaaggttaccggcaagtgc

SEQ ID NO: 6847 - DNA, 399 bp, Triticum aestivum
  Clone ID: LIB3281-044-P1-K1-H9
cccacgcgtccgattttccttttccgcttctcgacttccccaagcggccaccccccaccccctccttccttcctggccagcgcggcggctatggcctccatgaccacacctcggctccccttcctccccgcccgaacccgctccgccgtcgccgcctcctcctcttcgtccccctcctccccgctaccacgcctctccatcaaatgcagcagctccgccaacgctaactcggcccccctcccttctacatcgcggcagccccgggcgcccgtggcggacggcgtagggtccgccgacctcaacggcctccgggccccgcctatacctgtcgccgacccccctctgcccgcgtaccgcgatccgcacgggctgcctcggcctctcactagtgcggatcta

SEQ ID NO: 6848 - DNA, 408 bp, Triticum aestivum
  Clone ID: LIB3281-045-P1-K1-A1
cccacgcgtccgcggacgcgtggggtcgtccgcacgcgaccagcttgactccctcgcgcacgagcaacaggagcgcgaggagatgcagatcttcgtcaagaccctcacggggaagaccatcaccctcgaggtcgagagcagcgacaccatcgacaacgtcaaggccaaaatccaggacaaggaagggattcctccggaccagcagcgtttgatatttgctggcaagcagttggaggatggacgcacgcttgctgactacaacattcagaaggagtcgactcttcacttggtcctcaggctcaggggcggcacaatgatcaaggtcaagactctcactgggaaggagatcgaaatcgacattgagcccactgacacgattgataggatcaaggagcgcgttgaggagaa

SEQ ID NO: 6849 - DNA, 379 bp, Triticum aestivum
  Clone ID: LIB3281-045-P1-K1-A10
gagcccctcatcccaaaagcaaccgccatggctcagagccttctttcctctgcttacatcttattcaaccactgtgcgcctccctccctcgtcgcttccacttggtctgtggctaactcggccggatctcgggaggcagatcaactttgggtggatcctggcgaggagatccgtgtctcgcggcctgcacgcaactagatccggcgatacgtccatgtcccttgttgccaaccgtgggggcctcgcttgaagctggtgatgcatcctctgtattaggccatggcgttctttttccggagaaagctccggtgtgctggaagcagcgggggaggcacaccggacagctcggccgacggtgaggcctcaagttgacgagagg

SEQ ID NO: 6850 - DNA, 344 bp, Triticum aestivum
  Clone ID: LIB3281-045-P1-K1-A11
gttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggatgc

SEQ ID NO: 6851 - DNA, 392 bp, Triticum aestivum
  Clone ID: LIB3281-045-P1-K1-A12
cggacgcgtgggcttcaaaggtggtgcgatttcggatgggccattacaagcttccgcgaggatcagagacgtttgtaatggatgattatgagaataagatggtaaatgctgatgaaaaatacatgtggacttacacttcgccagagttccctatgttacagaaaaacgaactacaatccttcaagctcccacgccccgtcctttgcattggtggtgtggtgatgattgaactcttgggcagagtacagaaacaagaagcagatgataggtactacatatgcgtttgccatgctgaagtgatggggcgttcactctcaccacttttcatggttgaaatctcggatcctgaagggtattcaatccttaagtacctaccgggtgccaaagaccta

SEQ ID NO: 6852 - DNA, 362 bp, Triticum aestivum
  Clone ID: LIB3281-045-P1-K1-A2
aatggaaacgcatgagtgtggagaattaaggcactcgatgactcaggaatgtggatggagagaacgacagttgaagacatggatattgctgtgcgagcacatctaaagggatggaagtttctgtatggaattcttaacgatgttcagtgtcggtgtgaattgtcggagtcatacgaagcatacagaaaacaacaagatagatggcattctggtccggtgcagttgtttagactctgctttgtggacattatcaaatcaaagggtcatcatttatgtatttcctctttggagggcgatcttgttgcccactgagaagcaatccaagcagcagagagtaaggtctacgccgaaccttgacttcc

SEQ ID NO: 6853 - DNA, 401 bp, Triticum aestivum
  Clone ID: LIB3281-045-P1-K1-A3
cagaagatagggaaaagacctgaatatttggttcaaggaacattataccctgatgtgattgaatcatgcccaccccccgggagcgggaggacacattcccacaccatcaaaagccatcacaatgtaggtggtcttcctaaagatatgaagttgaagctcattgaaccactgaagctcctttttaaggatgaggttcggaagttgggaagtatcttaaatgtcccagagtcattcttaaagcgacacccatttcctgggcctggtcttgctgtacgtgtcataggtgacgttacagcaggcaatgctttggaggttcttcgtcaggtggatgagatttttattcaagccattaaagatgcaggcctctatgatgaaatttggcaagcttttgctgtgttttt

SEQ ID NO: 6854 - DNA, 352 bp, Triticum aestivum
  Clone ID: LIB3281-045-P1-K1-A4
cggacgcgtggggagccaaccaaccatcttgatcttgaggcttgtgtctggctggaagagaaattaaagaactttgagcgtatacttgttgttatctcgcattcccaagattttttaaatggagtgtgcactaacatcatccacatgcagaacaagaccctcaagttatatactggaaattatgaccagtatgttcaaactcgctctgagcttgaagagaattaaatgaagcattacaaatgggaacaggaacagatagctaatatgtaggagtacattgcacgatttggtcatggattctgcgaagcttgctcgtcaggctcagagcaaggagatgactcttgcaaagatg

SEQ ID NO: 6855 - DNA, 400 bp, Triticum aestivum
  Clone ID: LIB3281-045-P1-K1-A5
cggacgcgtggggagccaaccaaccatcttgatcttgaggcttgtgtctggctggaagagaaattaaagaactttgagcgtatacttgttgttatctcgcattcccaagattttttaaatggagtgtgcactaacatcatccacatgcagaacaagaccctcaagttatatactggaaattatgaccagtatgttcaaactcgctctgagcttgaagagaattaaatgaagcagtacaaatgggaacaggaacagatagctaatatgaaggagtacattgcacgatttggtcatggatctgcgaagcttgctcgtcaggctcagagcaaggagaagactcttgcaaagatggagcgtggtggtctcgctgagaaggttgtcaatgacaggattcttgttt

SEQ ID NO: 6856 - DNA, 316 bp, Triticum aestivum
  Clone ID: LIB3281-045-P1-K1-A7
gccttacacgatggccgcggcagtcactcgccgagccaactccctgggggtcgaggccccggacggcaactccgagagcgggcgcgccagcctagcagcagactcccccgtcgccaagcgggctgccgacgccaaggacgacgtgtgggtggccgcggacgagggagacacgtcgggagccatcgccggcgacggcaaccgaccgtcgctgttccggaccttcaaggtcaagggaagcatcctgcattcttacaggttcatgatcctcattcgtttgttcgccatcgggagtttcatcgcgtggcgcgtgaagcac

SEQ ID NO: 6857 - DNA, 274 bp, Triticum aestivum
  Clone ID: LIB3281-045-P1-K1-A8
cccacgcgtccgggggaagaagggcaaggccggcaaggaccccaacaagcccaagagggcgccctccgccttcttcgtcttcatgggcgagttccgcgaggagttcaagcagaagaaccccaagaacaagtccgtcgccgtcgtcggcaaagcggccggtgagaggtggaagagcttgagcgaatcggagaaggccccctacgtggccaatgccaacaagctcaagggcgagttcaacaaggccattgtcgcctacaacaagggcgagagtgct

SEQ ID NO: 6858 - DNA, 167 bp, Triticum aestivum
  Clone ID: LIB3281-045-P1-K1-A9
gaaccggaacggaagagcgcggggcgacccacgcgcccagaaaagaaaacgaaaaaagcaaaacaagaccaggaaaagaacccaaggggggagaaaagaaaaacccgaacgaacaaccaaaaaggaaaaaaaaaaaaaaacacagcaaaagacaaaaagcaaaaaca

SEQ ID NO: 6859 - DNA, 405 bp, Triticum aestivum
  Clone ID: LIB3281-045-P1-K1-B1
cgcagaggaggagagagagagggtagcagcagaggaggagagaggaggggggagtccacgtgagcccagcggaggaggcggaggaggagcgagagatccccctctccctccctctctccggccatggatcctccctacgcaggagctattattgaacctgctaaatgccgattgatgagtgtggatgaaaagaaggatcttgttcgtgaattgtcgaagaggccacaaactgctcctgacaaactacagtcatggagtcggcgtgatattgtggagattctctgtgctgatctcggaagggaaaggaaatatactggattatctaagcagagaatgctggattatctcttcagggtggtgactggcaaatcatctggccctgtggtgcatgtgcaagaaaaggag

SEQ ID NO: 6860 - DNA, 318 bp, Triticum aestivum
  Clone ID: LIB3281-045-P1-K1-B11
cggacgcgtgggttcgaggccgagagtgtgcagagccaccctctggtcaaggaaggcaagctcgccaacctcctcgcatggcgggcggaggaggattccctggaggagggcgcggtgctgtgcgagtgattggctgtcgctgttccgtctgtggactttgttctgactaagtttgtcgtttggttactgtgaagcagctggccaggctattgctactccgaataaactattagctctaggtggtttgctgcgtctgccacaatgagcgtacttctggggagaagttgtctcaaactgataaataagcattttttttct

SEQ ID NO: 6861 - DNA, 402 bp, Triticum aestivum
  Clone ID: LIB3281-045-P1-K1-B12
cggacgcgtgggcggacgcgtgggcggaagcgcccctctctctcttccagctcctcctcctccaagccaccccgattcgatcactccccgagcagaatccccccgattcgatcggcggcgaggagaggagaggacgggaggggatgaggaagcgggagcgggagaacccgtgcgggatctgcgggcactaccacaagtacgaggagggggagccgtgcggggtgtgcggccaccgcccgccggcgctgggggccgcgggggcggcggcggcgccgcggcaggagtcggccttcccctcggagatactcaaggacttccttttcctcggcagctacgacaacgcctcccgctccgagctcctcaagaccattggcatcttccacatcctcaacactgtaccct

SEQ ID NO: 6862 - DNA, 389 bp, Triticum aestivum
  Clone ID: LIB3281-045-P1-K1-B2
cgactggcgacagagcagcggggcagcgggccggcagacggagaggggcgcggccgtcttcccaaacccgagggtcctcaccatggatctttccagttcactggcttcaaccagtgatgaagagacaagggcacttaatgcattgcttgatgctttcagttgtgccttttcacttgaagatatagccaatgcatactgcagagcaaacggcgatgtcaacaaagctggggatttcttgactgaccttcaactttcgatgccccagagtgatgaagttgactcgagcgttgggaccaatcttccccagtttggtaaggcagttgaggaaaattctctggacaactcaaaccaaacaaggaatctttcctgtgtcgggaaagcagctgaag

SEQ ID NO: 6863 - DNA, 356 bp, Triticum aestivum
  Clone ID: LIB3281-045-P1-K1-B3
cgggccgtcttttggttctactgtcagtgagaagatggggagcgcggatgtggccccccggttctgaagacgacgtagaattaatggtcatttagttttgaagataaaattgttgttgtgttttgttttcttgccatctgccgctgatgccagatgcctcacccctgggcaggaccagatttgatgcaaaccctgcccctatttcccctatcaataagaaaaggcacgatgtattgtgaactttcttgagttggaaaagcaaagtaaatcggatcgttgctagggtgacaacaattgcagaatataaatctcatcgctcatgtggctgagcaataaaattgtttcaaattctgttg

SEQ ID NO: 6864 - DNA, 404 bp, Triticum aestivum
  Clone ID: LIB3281-045-P1-K1-B4
atactaagcccagtaatttcagatgctggtgtgttgaaaggagattatgggatgcatgaaggcaataacaatgttgattccagtgatgatataaattcatttcctaccatggaaaatgaatccagcacttcagaagcggaggtttcagttcatccaggcggtgagcaatcagtgctatgctgtctatccaaagtaaataattccgagcaacatgtcgtcgaagcgaattccatagatgaagttaactcgttattcaggagccgcatggaggaagtgctagtgcagtccgtttcagagcccgttatggggcaacctttgacagttacacttgaagatgactcgagtgacccggcgttatgtccaaaccccgggatgcatgccattgaagcgagttcagttgaaga

SEQ ID NO: 6865 - DNA, 404 bp, Triticum aestivum; identical to SEQ ID NO: 6864
  Clone ID: LIB3281-045-P1-K1-B5

SEQ ID NO: 6866 - DNA, 382 bp, Triticum aestivum
  Clone ID: LIB3281-045-P1-K1-B6
atcatgaactgatgcattcaagggttctgcaaaagctggaaggcactctttctcctttgcatttggaggaaatggatctggcacgatctttaagggaaaataaattcagaattaaattatgtgagtattcatatgaattacttctccagtatctccagagaacacaagctcttgtgctgctcggaataatcaatgaacggatacttcttgaagtgtccgttgaccagccttcattgatctctgatgatgcggatgctgttgctctggttggaaccagcaaagactcggcaaaacagataaatcagaaggaagcgcattgggtgtcgcttgaagatccacatgtggagcgtatggagaaagcactcttagagtctgatcgagc

SEQ ID NO: 6867 - DNA, 400 bp, Triticum aestivum
  Clone ID: LIB3281-045-P1-K1-B7
cccacgcgttcggttcccccctcctcgctcacaaccgagcgcggtcctgtccgtgccgccgtcgatcccgcggacaccgtgttccacgggcctcgcgagggtgtccagcaactgcgccaccgtcacctacatgatctgcgaggagcgattcatgctggagcgctctacatcacacccttcgtcatcgtcttcttcttcggcagccacgcgacgtcgccgttgattcgcagcacctagatcccctacgactgccccgagcccttcacgagcatacttactccgagaccgctgtcgatgtccgcgtgttcgactacattgaagatgacccctccttgccaaagcaaccagacgatggagttcacgagccagatgccatcgtcgacaatgactgctactacac

SEQ ID NO: 6868 - DNA, 360 bp, Triticum aestivum
  Clone ID: LIB3281-045-P1-K1-B8
catcaagatgcgtgagatcgccgaggcttacctaggagtaactattgggggtgctgttgtgaccgtgcctgcttacttcaatgattcccagaggcaggcaaccaaggatgccggtgttattgctggtcttaatgtgatgcgtatcatcaacgagccaacagcagctgcaattgcctatggtcttgacaagaaggctaccagtgccggtgagaagaatgtgcttatctttgaccttggtggtggcacttttgatgtctccctccttaccattgaggagggtatttttgaggtgaaggccacggctggtgacactcatcttggtggggaggactttgacaaccgtatggagaaccactttgt

SEQ ID NO: 6869 - DNA, 405 bp, Triticum aestivum
  Clone ID: LIB3281-045-P1-K1-C1
cggacgcgtgggcggacgcgtgggcggacgcgtggggccaactcaggtagcagcaactagagccgacatgatggcggaggcgtggatggacgtgctgccgccgccggcgccctacttcgccgggcagccgtgttgggccgtgcagcaggagcgtcgcggaggcggcgcctggacgctggaggagaacaaggtgttcgaggaggcgctcgcggcgatcgacctggacgcgccggaccggtgggagatggtcgcgctgatgttgcccaggaagacggtcgccgacgtggtgaaccactaccgggccctcgagaacgacgtcgggttcatcgaggccgggctggtcccgttccctcactacgacagctcgtccccttcgtccgggttcactctggactgggacggggg

SEQ ID NO: 6870 - DNA, 402 bp, Triticum aestivum
  Clone ID: LIB3281-045-P1-K1-C10
tcgtcccctccgcctccccccaacccctacccaaccaatttgctgacgcccacactgacgagcgacgctccggcggaagaatcatggcctgagccgagcccgggatcctcgacgcggaatgggtgctgtaaaggatagcttcgctgtgctgctcaaggaaggcatcttcttgtctgtgtagttattagttgtttgggtgctataaaagtgcctcggcctgtggatcaggactgcaagatactacagtaggggtaagggagaagaaagcatttggagagtcacaagatggaagaaggtcaggaaagcaggtactggtgccacagctgcgctgaggtgattgttcctgtggagccggagaagaagtgcccggactgtgatggcgggtttgtggaagagatgggg

SEQ ID NO: 6871 - DNA, 401 bp, Triticum aestivum
  Clone ID: LIB3281-045-P1-K1-C11
tgttgatttcatacaccattgttccctcgaaaaggaaagaaccagccctacgaggattccaggataccgcaggtaccagctccgtttccgatccaagatataaaagaaaattcagcgaaagcaggagctgtgaagctaccctggcggaagaatcgactgaaagcggcagggtgaaggaaggatccactgccggggaaagatgcggccttactttgatcccgagtatgagaacttcaatcagcgcatcaaccctcctcgggtctgcatcgacaacaacacatgccgcgactgcaccctagtgaaggtggacagtatgaacaagaatggcattctgctggaggtggtgcaggtcctgagcgatcttgacctcaccatcttgaaagcttacatcacctcggatg

SEQ ID NO: 6872 - DNA, 401 bp, Triticum aestivum
  Clone ID: LIB3281-045-P1-K1-C12
gaaaaccaatgctgagctagagagatgcacaagcaattttatgaagttgacgaaatatcacctttctacattcaaggaagttctaagcccatcgattgagcggatccacacatacgtggataatttggcattcttaaattcaagggatgactcaacggaacttgaagacgaggaggtgtcagaaaagacaagcccacagaaagcccttgaggaggaatatttggaaactgaaaagaagatcgtaattgccttcagcatcactgatcacatgaagaagctattttattccgaacaagggtacagttctaggagagatgatccagaggtcaggagcttattttcggagatagagaaactgagagaggcattcgagtctatagaaaggccgacactagaaatcg

SEQ ID NO: 6873 - DNA, 138 bp, Triticum aestivum
  Clone ID: LIB3281-045-P1-K1-C2
cccacgcgtccgcccacgcgtccgatttatctttcatgtgattgtcctcgttctccttctcataagctcaaaaactgagccttctgatacaaaagtggagataaacagaaggctcagttgtagagtttatgggaagga

SEQ ID NO: 6874 - DNA, 385 bp, Triticum aestivum
  Clone ID: LIB3281-045-P1-K1-C3
atcgtcgtcctctgcggcaacggcgacgtgcccttcgccttccacagcctcaggagcgacaactacagcgtctccttcggggtggtcaggatggctaggtgcctcctgacgagagtcctcagctcgccgtcggtcttcttctccaccatcgacctctccatcaccttgctcctcttcctcgtgctggtgtacgagcaggtgtgggagtttgtggtcttcctcttctccaactggttcctcgtctccatgctccacgggtacgccgccaagccccactggcgccggagcgccgccttcagctgggccgtccgccgcatgctgtgggtgcggagcaagatgagccacccggacatcaccatgaggcagttctccgcgctcaggtcct

SEQ ID NO: 6875 - DNA, 359 bp, Triticum aestivum
  Clone ID: LIB3281-045-P1-K1-C4
cacacgccgacgtagaaagactaagattacgccactgattttaaggctgttggtagcttacctgctacagattatgatatcaagctcaatgtggtcctgcacaaaaggcatgacgaggagaaaactgctataacggtagagtagagggtgaaaaacactgtgatactctgtcactgttcacttgtccacatcaatgctgacactaagaggtacttcagatatgatcaagatgtagaaaaacaattagagtcttcaccagatggatgcgttgtggcatatctcccgttaggagcagccttcacaaatcactgcatctgcgatacagatctatagatagctgaatcaatggtgtatgaatg

SEQ ID NO: 6876 - DNA, 342 bp, Triticum aestivum
  Clone ID: LIB3281-045-P1-K1-C5
catacgcggacgtagaaagactaagatggcgccactgattttaaggctgttggtagcttacctgctacaatttatgatatcaagctcaatgtggtcctgcacaaaaggcatgacgaggagaatcctgctataacggtagagtatagggtgaaagacactgtgtactcttacaatgttactgatcacataaatactgcactgaaggtgatttcagatatgatcaaggtgtagaagaacatttagagtcttcaccagatggatgtgttgaggcatatcttccttttggagcgtccttcacaaatcactgcatctgcgatacagatctatagatagctgaatcaa

SEQ ID NO: 6877 - DNA, 404 bp, Triticum aestivum
  Clone ID: LIB3281-045-P1-K1-C6
agcggctggggcttatccagaactggcagtgcaaactatggccaagatctgcttgcaggccgagtcatgcgtggactattctgctgtttttaaatcaatcatgtcatcagccccgattcccatgagcccattggagagccttgcctcatcagctgtccgcacagccaactcagccaaggcgacgcttatcttggtactgaccaggggaggaacaactgcaaggcttgtagccaagtacaggccatccatgccgatactgtctgtggtggttcctgagctcaagacggtcgagtttgactggatctgcagcgacgaggggcctgccaggcaaagcctcatcgtgaggggcgtgatccctatgctcagtgctggcactgccaaggcgtttgacagcgaagccacgg

SEQ ID NO: 6878 - DNA, 400 bp, Triticum aestivum
  Clone ID: LIB3281-045-P1-K1-C7
cggacgcgtgggcggacgcgtggggctactctcgcggcgcacgcgctgccctcccctcctctttcctcccccctggcgtcgacgcggcggcggctcccggcggtggccaggcgggcgcggctacgaggaggtgggcgtgcgcacggcagggccgagctcaggctagggttcgaggcagcggcattggcggcgtggatgaggagctaggaggtgctcggacggtggggaacggcggcagcggcggttgcatgcaggcaggccggcagccatgtatttcgccaggctcgatgactcgcccatgttccggacgcagatacaatcacttgaagaaagtgctgaagtactaagagagaggtgcttgaagtttcataaaggttgccgcaagtatactgaaaggcta

SEQ ID NO: 6879 - DNA, 398 bp, Triticum aestivum
  Clone ID: LIB3281-045-P1-K1-D10
cgcgacttccctccggttgcttccgccgagcgacttccaatccagtctcccctcgattccgccggcccgatcgcctcgatcaatctcgtccccggctgcgccctcccgtcggttggagatggccaagacttgcttcaagaccgagcaccccctggaaaggaggcaagctgaatctgctaggatccgtgagaagtacgctgacagaattccggtgatcgttgagaaggctgataagtctgatgtcccggaaattgataagaagaagtatcttgtcccggccgacctcactgttggccagtttgtctacgtggtgcggaagaggatcaagctgagcccagaaaaggccatcttcgtctttgtgaatagcaccttgccaccgactgcttcgttgatgtcag

SEQ ID NO: 6880 - DNA, 398 bp, Triticum aestivum
  Clone ID: LIB3281-045-P1-K1-D11
cggacgcgtgggttttttttttatactaaatcacaccattccatttccacacggccagttcaccatagcagcagtacaaaaagttacacactggacactgcaatcgctaggtaaatatagtgacagtgacactactatagtagtatacggctcggtagttactactactggcgactgcgagaaacggccaactactactactgcgttaacgttgcaagctactccagcttgcttagctgcagatgggtcggtggcagagcacggcgcggcccccctctccgtccggccggttgctggggaggaaccgaatccacctacgtaccgcactctacaccgtggcgacacaagaaatcgactcaaaccaaaggccttccccctcgctacgtacgtacgtactc

SEQ ID NO: 6881 - DNA, 264 bp, Triticum aestivum
  Clone ID: LIB3281-045-P1-K1-D12
cggacgcgtgggttttttttttatactaaaccacaccattccattttcggagggtctgctcacggtaggagctgttcaaaaagtcacacactggacactgcaatcgctaggaaaatttagtgacagtgacacttactatagtaggttacggctcggtagtaactactactggcgactgcgagaaacgggcaactactactactgagataacggtgtatgctattatagcttgcttatctgcagatgggtgggtggcagagcacg

SEQ ID NO: 6882 - DNA, 406 bp, Triticum aestivum
  Clone ID: LIB3281-045-P1-K1-D2
cccacgcgtccgcggacgcgtgggttttttttatgtcaacatcaagtggaaaacaaaaattagaaatgatatagtatcataaggtaagggtaacccagatccacgtatgtcaacatcaagtggaaaacaaaaattagaaaggcatacttgcagaagttgcattttgaaccaaatggtatttatctatgtataaaacagggtgtgaaatccaactagaacttgaggtgaacaaaagacaagttttgatgtagatgccaaccacgctctacctaatccattagaaagctacagataacatgaacgatacatatcaaaggattgtcccccctgcgtaactgtgtccttcatggcaaacagtgaataacttcgctggcactcatgaagatgtttgcgggcaaaaatacca

SEQ ID NO: 6883 - DNA, 396 bp, Triticum aestivum
  Clone ID: LIB3281-045-P1-K1-D3
cggacgcgtgggtcccatggctgtcctcctgcgcgggagcacaaccgcaacagcgaccgccatggatcccctgcttccaaccacgccaagttcgtcgtcgtcgcaccgagcccgtcgccggccgccgacattgcctctgcttcgcaccccatgcgccgctgtgcccggcttcctctccttctccgagtggtgcacctcaggaaccggccaaggattcccgggccgccatggttcctcctcaagctccaagtcctcgcatctccagccatctgtggcgttcccgcgccaagctgtcgtccccttccttgcctgaagtcgccgtgcccggttccagactctgcatcgagcagaggaggacgaacgcctcgcccgatccgttccaagtcaggcgcccgc

SEQ ID NO: 6884 - DNA, 321 bp, Triticum aestivum
  Clone ID: LIB3281-045-P1-K1-D4
atcgtgcggctgtgcaataacggcaacgtgcccttatcatttcacagtctcaggagcgacaactacagtgttttcttcggggtggtcaggatggctaggtgcctcctgacgagagtcctcagctcgccctctgtatatttttccaccatacacctgtgcataacctagctcctgtttcttgtgctggggtaccagcaggtgtgggagggcgcggtcttcctatcctccaactggttactagtctgcatgctccacaagtacgccgcctagccccactggcgccgtagcgcggtcttgaactgggccgtacgccctatgctg

SEQ ID NO: 6885 - DNA, 378 bp, Triticum aestivum
  Clone ID: LIB3281-045-P1-K1-D5
atcgtgaggctgtgcggcaacggcaacgtgcccttagcctttcacagtctcaggagcgacaactacagtgtcttcttgggggtggtcctgatggcttggtgccaactgacaagagaacttaggtcgcccgctgtattgttttccagcatccacctgtgcataacctagctcctatttcttgtgcaggggtaccaacaggagtgggagtgtgtggtcttcctatcctccaaccggttactagtctgcatgctccacaggtacgccgcctagccccaatggcgccgtagcgccgtcttgtactaggcacgacgccggatgctgtgggtgctgaaaaagatgagccaccctgacatcaccatgaggcacttcttcgcgctc

SEQ ID NO: 6886 - DNA, 396 bp, Triticum aestivum
  Clone ID: LIB3281-045-P1-K1-D6
cccacgcgtgcggggacgcgtggggaaaagacgagtgtgttcggcacgggttcgctccttttgtccgtcctctaggcggcccttctcttcacgcgtcactgccctggccaccggccggactagctggtgggctaagccctgccagtgtgggggcggcggcggtgtgttcctccttaccccggccggaacgaccgtcgcgggatccaagatcgggcggcggctcagggctttcctcaagccgcgggagcagcagccggcggctgagactcgcgctgcggatggccgtgtgaatgctctgacgcatgctgctgcgcgatgggctaccgcagcgctgaccctgtcgatgtgcggctagatctggccccacgcgggccgggccggctgcggtcctagctg

SEQ ID NO: 6887 - DNA, 401 bp, Triticum aestivum
  Clone ID: LIB3281-045-P1-K1-D7
cggacgcgtgggccaatattgcatggggttggactacaaaagacacactattctttttcaattggatatgattgatcatatatcatgtatttcttgtttatgtatgtactcactaacacttggacaggtaacttggttaaagctgtcatcccacgacctgaccccagcggcgctgctgttcctggagttggaaaggtgtttctggaatatgcagatatcgacggctcgaccaaggcgaaggtcgggatgcatggcaggaagtttggcgggaaccaggtggtggccgtgttctaccctgaaaacaagtttgctgatggagattatgatgattagatgaagtcctctgctcagttgtcacccgtgccatgcgtttgcttagttttcaaattgaatcctttttt

SEQ ID NO: 6888 - DNA, 391 bp, Triticum aestivum
  Clone ID: LIB3281-045-P1-K1-D8
ctctcctttccccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccaccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaaca

SEQ ID NO: 6889 - DNA, 400 bp, Triticum aestivum
  Clone ID: LIB3281-045-P1-K1-D9
cggacgcgtgggcataaactcatcagatccgaataatcggttctgcgaggaaaaagctctctaacctctaactgctctcgggtcgctcctcgtgggcgactcgagggcgacaaaccctagctctctcaggcctccccctcctcccttccccgccccgccgccacccgaggtggtcgccggcgttcccgcgccgctgtcagtgaaggtggcggcgaggtccctgctgccctgcatcttgtggggagctttggtacgccggggcggcggccctgggtgagaaggcggcgtcgacctcggctggcgggtggcgccgcaagtgttggctggccctcccggtcacgtgggcggcggtggctcctcgcggcgtggtctgccccggcggctgcgccagatctggatc

SEQ ID NO: 6890 - DNA, 322 bp, Triticum aestivum
  unsure (1)...(322): unsure at all n locations
  Clone ID: LIB3281-045-P1-K1-E1
agggcctctctctccatcccgacctctcgtggccgccgcgaagaaaaggagcttatcatggcttcaaaacgtatcctgaaggaactgaaggacttgcagaaagatcctccgacatcatgcagtgcaggtccttctggcgaggatatgttccattggcaggcaacaattatgggtcctcctgatagtccctatgctggaggtgttttcttagtgaatatccatttccccccggactaccccttcaagcctncgaaggtatcgttcaagacaaaggtcttccatccgaacatcaatagcaatggaagcatatgcctcgacattc

SEQ ID NO: 6891 - DNA, 402 bp, Triticum aestivum
  Clone ID: LIB3281-045-P1-K1-E10
caccgcccgaatccagccagccagccagccaggcgaagctgcgaggatgtaccgagatcccaatcccttcgacgagggcgccgacgacagcgccttctccaatgggggaggacgcggtggtgccgctggtggtggtggcggcaagtcgcagttccagtttcgcccgacggagcccgtcggattcggcgccggtggcaacggggacgccgccgtcgacatcccccttgacaacatgaacggttcgaatggcaagcaaagtgagctctcgcagtggcaggcagatctcaagaggcgagaggcgaggagggaggaagctctcaagagtgctggggtgcccatggaggacaagaactggccgccattcttcccaatcatccaccacgacattgcccatgaaatacc

SEQ ID NO: 6892 - DNA, 402 bp, Triticum aestivum
  Clone ID: LIB3281-045-P1-K1-E11
gttcgctgttaaccagcatcgctactacaggaaaggctccatattccagtgttattacccacggttttgtattggacaaagacggtttaaaaatgagcaaatctgttggtaatgtcgtggatcctgagaaagtgattcttggtgggaaagattctaagaaagagcctccttatggagcagatgttctccgtctatgggtttctagtgttgattacactggagatgtgttgattggttcggaaatcttgcgccagatgtctgacatgtatagaaaactacgaggcacaatgcgttttctattagcaaatctccatgattggaacccagagaattctgtgccctacagtgatctgccgaaaattgaccagtacgcacttttccaactggaaaatgttgtggctt

SEQ ID NO: 6893 - DNA, 388 bp, Triticum aestivum
  Clone ID: LIB3281-045-P1-K1-E12
cggacgcgtgggcgagacaaggccgagaggaggaggaagaaggctccgggaagctcgagaagaggcgaggaggagaggagagggatcgcgttgcgcgtcgtcgtggcgatggatcgggtccgcggctccgcgctgctgctcggcgtcctgctcgcaggatcactgtttgcactttgtgctgcaaaggaggaggccaagaagctcggtaccgtgatcggtatcgatctcggtaccacctactcatgtgttggtgtgtacaagaacggtcatgtcgagattatcgccaatgaccagggtaaccgtatcacgccctcatgggttgggttcaccgatggggagaggctcatcggtgaggctgccaagaatcaggcggctgtcaaccctgaga

SEQ ID NO: 6894 - DNA, 305 bp, Triticum aestivum
  Clone ID: LIB3281-045-P1-K1-E2
cggacgcgtgggttctcctccccaaacccagaaaatccccttatcccctctccccctgcttctcgaccgtccatggcgatggcctcctccgtcgccgcggcgtccctccgagcgctcgccggcgcctccccggccccgctcccgaagccgttcctcgtgctgctcttcccggcgcccccgcgccgccttggcctcggcctacgcgccggccgcccgagcggtccgttcgccccggtcggcttctttgacttctttttcgaaaccttcgcggccgtcaacgtcgccgagccggatgaccaggccct

SEQ ID NO: 6895 - DNA, 397 bp, Triticum aestivum
  Clone ID: LIB3281-045-P1-K1-E3
ctgacaatggcgtcgcctcgattcggatctggagatctgggctcgctgggcttgtcgtgaagacctcgtggtggcatgggggagccaccgagtgaaaactctgcgctttgtcgccgatgatgatgacgctagcgggcgccgctctcttcttgaagacgttgtggtggtgatcctctccgtgtctgggttccggatgaaaatctttgtccagtgtggactcgggagcgacgatgcttagtgccattcttcctctcgggggcgttgtggtggagcttaggtgttatagggcgtagcgtggtgttgtactcggttctttctgtgctatttttgggtagcatagttgcttgcgttctgcatggtttgattatcctaaaatcggcattgtatgacggctacc

SEQ ID NO: 6896 - DNA, 302 bp, Triticum aestivum
  Clone ID: LIB3281-045-P1-K1-E4
ctgacaatggcgtcgcctcgattcggatctggagatctggtctcgctgggctgggggcgaagacctcgtggtggcatgggggagccaccgagtgaaaactctgcgctttgtcgccgatgatgatgacgctagcgggcgccgttctttttttgaagacgttgtggtggtgatcctctccgagtctgggtttcggatgaaaatttttgtccagtgtggactcgggagcgactattcttagtgccattcttcatgtcgtaggcgttgcggtggagcttatgtgatatagggcgtaggcgtgtgtt

SEQ ID NO: 6897 - DNA, 406 bp, Triticum aestivum
  Clone ID: LIB3281-045-P1-K1-E6
cacagtccccacgcccctcactcctccctccctcgtccgccgccgcgctccctgcctcctccctcctcttcctcctcctccctcgtctccacggcctctgccctaggagccccactgccgactgctactccaccaccacgccccttcctcctcctcgccttcccatcgctcgtgcacaggtcgccgctgtggcagatcagggacagtgctgggtcgtcaagatggggtggttacaaaggcttcccagcccaacggcgccgtcatgggaggaggctcaccatcgaagagtagccgcaggtgcacaacatccaaagaggtgcagccgggaggaggtgaggataagtcgcttgattgacaagagcagagcagcggattggatcgagggggcctgcatgtccacgccgcc

SEQ ID NO: 6898 - DNA, 181 bp, Triticum aestivum
  Clone ID: LIB3281-045-P1-K1-E7
cccacgcgtgggccgactcgttgttcctccccgtcagacgccaccacggggcggtgttcttggcggcagtagagattcatccgtccgttcaagccgatatcagtgcggagcatgtgtaggaaaccgtactgagggccagcagccatgatgttctctagccatgtcgacgccttttctccgt

SEQ ID NO: 6899 - DNA, 404 bp, Triticum aestivum
  Clone ID: LIB3281-045-P1-K1-E8
tcggtgatactcagaagagcatgggtgccagagacaaaaggagcatattactgtcactttcagatagtgaagctgaggataatgataggactactatatctagaggctctcagaataaagaggtcccaaagagacgagggcgttccatttttaatgaagagcaagagaagcttatcagagatcttcatgagaaatataaggatgatcgtaaatgcagtcatctaattgctgaagctctagatcccagtggaaaggtatcgtcagctcaaatttctcgaaagcttacacagctaggtctcaggagtgtcactaggaggacaaaagttccagaggcatctctttcagccgaagatctggttacacaaccacaaaacaacgtgctggatgatccgaagccagaaagc

SEQ ID NO: 6900 - DNA, 399 bp, Triticum aestivum
  Clone ID: LIB3281-045-P1-K1-E9
cccacgcgtccgcggacgcgtggggtaggtgctacggaggggagagcgagtggagtcgaggaagcagcagggatagcaggaggagcgtaggaggaggggaggggtgcgagagagatggggtccggatctttcctcaaggtgctggccaagaacttcgacgtcctcgccgggccactagtttcgcttgcttatcctctatatgcctctgtgagagcaattgaaacaaaatctcaagtagatgatcagcagtggcttacttactgggtgctgtactcgtttatcactttgtttgagctcacttttgctccgatacttgaatggcttccattctggccctatggaaaactgttcttcaactgctggctagtcttcccctgcttcaatggtgctgcttatgtt

SEQ ID NO: 6901 - DNA, 368 bp, Triticum aestivum
  Clone ID: LIB3281-045-P1-K1-F1
gccagcgccagcgccagcagcgccatcacttccccactcctccactagccactgcccctccctcccacacagacacgctctcttcccccatccatcctccctcctcccaaagagagcttgagcaacagcttggcaacggtggtggctcagcagagatgaccaaagatgaggacttcaagctggtcaagatccagacccatgtcctgagggtgaacatacactgcgacggctgcaagcacaaggtcaagaagctgctccagaggatcgaaagcgtctactcggtggccatcgatgtggacaaccacaaggtcacggtgaccggcagcgtcgactcggagacgctcatcaggaagctcaccagagggggc

SEQ ID NO: 6902 - DNA, 299 bp, Triticum aestivum
  Clone ID: LIB3281-045-P1-K1-F10
tcagggccgaatcatcgagcgccgcgcatgagcagctggagattcgtggagggctccaacgtctgggtgaatttggtggcggtccctgccaatttcgccatcgccgtggtggaattcgcgctgtggagctccgcctggtgcttcctggccatcttctccgccaacttctgagccagaatctcacgctgtttctgattcccaacctgtcggtgcagattggattaggattgctgtaattggggctgaaaatgatttttagctgattttaagaggggggtcatttgactggattggtttga

SEQ ID NO: 6903 - DNA, 348 bp, Triticum aestivum
  Clone ID: LIB3281-045-P1-K1-F11
cttatttcttgttgaatgccgagaactatcattggcaatggacatcggggttctcggctgaataaccggcttggttttatatctaatccccttattctaatatcacgtggagaccaagatggtagggtttttccagactagcttctactttggctacacgttgatgttctgtctggggctaggcatactttgtggtgctatcggctatctggggtgaactctggttgggaggggaatctacagaaacatgaaatgcgactaaactactactccgattttgtgggctattagcacttaacagatcatgtgttgttgagtaacgcttctaagattctaattaacttttgg

SEQ ID NO: 6904 - DNA, 417 bp, Triticum aestivum
  Clone ID: LIB3281-045-P1-K1-F12
ctgagagcctagctgctgccctattgagaataatggagagtaggaaaggccaggagaacttccagctgattataatcacccatgatgagcggtttgctcagcttatcggtcagaggcagcttgctgagaagtattaccgaatctccaaggatgagcagcaacacagcaaaatagaagcccaagagatatttgactaactatgtttgcttggaacatatatgctcccagtgctaatcctcctttaccggccaagtgtgtgcggttcattatgatgggctgtcatggagagaactgggtaccagcgaactggtagtaggttctttagtttggtttctgtgcatgcaattgcttgcttattcttgtatataatctggaggtggtactgtgttgtgacttttctcttctcccttattcttg

SEQ ID NO: 6905 - DNA, 402 bp, Triticum aestivum
  Clone ID: LIB3281-045-P1-K1-F2
cggacgcgtgggcaagaaaaggagatgaagactctacaagaagctgagctcagactgctggaagaaactgctgcaagagaagctgctcttgagaaacaaaggcaagaggaggaggaacagcgtaaaatgcaacttgagaaagaggagcttgagtccaatcttgccgccaaagaagcatcattgccattggagccaccttcagacaaagaaggtgttataacacttgtagttcgcatgcctgacggtagtcgacaggggcgtcgctttttaaaatctgataaattcaagtccctttttgatttcttagacgttggcaggacttgcaagccagaaacctacagactggtaaggacataccccaggcgtgcttttaccactgctgacggcgaccaatcatttact

SEQ ID NO: 6906 - DNA, 378 bp, Triticum aestivum
  Clone ID: LIB3281-045-P1-K1-F3
cggacgcgtgggcgaggtactcggaggtggggagctcgaggtgctgggtgcgggagctcgaggagctgacgccggcgacggggtcctagtgctagggatggagctcaaggttctggccggcgggagatcgaggttctggccggcggacggaggttccgcgcggtggatcgcgacgagcggacggagaactgggtactggattgtaatgatttcaaatttcggaagggccttattgtaaaattgatttgttcacgattccgcctcccctggagtcatctattaccgaacggagggagtattaaattgccatcctggataaaacactcacatctgccatatgggtctgagcacggcaagatacttgacactatttttgga

SEQ ID NO: 6907 - DNA, 403 bp, Triticum aestivum
  Clone ID: LIB3281-045-P1-K1-F4
cccacgcgtccggtttgcatattcaaatgccaagacagaggacttgtgggctgccctcgaagaggggtctggtgagccagtgaaaacattaatgcactcatggacaaagcagcaaggttatcctgttgtcagtgtaaaactcaaggatggaaagctagagctggagcagacacagttcctgtcaagtgggtctgaaggagttgggcaatgggtggttcccatcacactatgctgctgttcatactcagttcagcaaaagttccttttccgtggaaaacaggacgatttcaatttgtcaggtctcgtagaatgccaaaagaaagatgatttctggattaaacttaatgtcgaccagactggtttctatagagtgagttatgacgaggaacttgcatcccgactt

SEQ ID NO: 6908 - DNA, 391 bp, Triticum aestivum
  Clone ID: LIB3281-045-P1-K1-F5
cccacgcgtccggtttgcatattcaaatgccaagacagaggacttgtgggctgccctcgaagaggggtctggtgagccagtgaaaacattaatgcactcatggacaaagcagcaaggttatcctgttgtcagtgtaaaactcaaggatggaaagctagagctggagcagacacagttcctgtcaagtgggtctgaaggagttgggcaatgggtggttcccatcacactatgctgctgttcatactcagttcagcaaaagttccttttccgtggaaaacaggacgatttcaatttgtcaggtctcgtagaatgccaaaagaaagatgatttctggattaaacttaatgtcgaccagactgttttctatagagtgaagtatgacgaggaactt

SEQ ID NO: 6909 - DNA, 407 bp, Triticum aestivum
  Clone ID: LIB3281-045-P1-K1-F6
ggagagagagagagaggccggcggcggcggcggaggagcaggcgatcggagatggtgcggaaggcgaaggtcgagttcgacgagaggccgccggatgacttcgacccgaagaacccgtacggggacccggtggcgatgctggagtacagggagcacctggtgcgggagaagtggatccagattgagaccgccaagatcatccgcgaccgcctccgctggtgctaccggatcgagggcgtcaaccaccaccagaagtgccgccacctcgtcgaccagtacctcgagtccacccgcggcgtcgggtggggcaaggaccaccgcccggcggacctccacgagcccaagaaggtggtcgaggtcgaggagtagcacggtcgcttccgtcgccgttcctggaatggagaggt

SEQ ID NO: 6910 - DNA, 365 bp, Triticum aestivum
  Clone ID: LIB3281-045-P1-K1-F7
cggacgcgtgggcggacgcgtgggccctccccgccagacgccaccaccaccggtgccggcggcggcagaagagatccatccgtccggccaagccgagagcagagcggagcaggggaaggaaaccggagagagggccagcagccatgatgttcttgagccaggtcgacgccttcttgccgtcgcagttcaccgcgtcgcaaaacgccggcggcgacttcacccccaacaagttccggggcgcgtcgggcacgatgccgctgacggtgaagcagatcgcggacgcgcagctggccggcaccggcgagaagggcgcgcccttcgtcgtggacggcgtcgagacggccaacgtcaggctcttggggatg

SEQ ID NO: 6911 - DNA, 384 bp, Triticum aestivum
  Clone ID: LIB3281-045-P1-K1-F9
gattagttgaccggctgtagtttgatgacagaagcattgtttgaggaaatgtttccgcagtcaagaatggttgatgtgccgaatagatagtaaagaaagagaatgtgattctttgtttattatacacggagcacgttccaactagggcatgcaaatcctaaagtatggcacatgcaagtatcgtttgaccataatgtagctctaatttataagcctcttaaggctttgttgaacaaaaaacaggtgaatgaagctagaggaaaggataaacataattagaatcaggaaccaagttcaacctttcactggaactggagtatggataggtcagtatattagcctcatatccttgggtaaaacttggattaactcccattcttttct

SEQ ID NO: 6912 - DNA, 388 bp, Triticum aestivum
  Clone ID: LIB3281-045-P1-K1-G1
cggacgcgtgggccacctatctgcccccgccgacggcacgcccaccgtcggggacgatggcaactactgcctcaccctacaccacgaccaccccccggtccttcctctcgtcgccttcctcctcactcagggcatcgaagtcgaaccacctccggacgacgagaaggctggccgctaatgtacgctgcgccagtagctctccggccgccgatacatcttacacgactaaggtttcgcggaatgccaacatagccaagctccaagcaggctttttgtttccggagattgccagaaaagggcacctcatctgctgaagcatctgacgccaaaatataagtctgggaataggtgacactactgagcccattccggaggtcataacaaatgc

SEQ ID NO: 6913 - DNA, 403 bp, Triticum aestivum
  Clone ID: LIB3281-045-P1-K1-G10
cggacgcgtgggagacggccgagaagtcccccaaggagcagcaccgggttgatgttggggatcacgccgccgtgcgcgatggtgatgccggcgagcagcttgccgagctcctcgtcgttcctgatggcgagcagcaggtggcgggggatgatgcggctcttcttgttgtccttggcggcgttgccggcgagctccagcagctcggcggcgaggtactcgaggacggccgcgaggtagacgggggcgccggagccgacgcgctgcgcgtagcggcccttcttgaggaagcgcccgatgcggctgacggggaactggagcccggccttgacggaccgcgacacggacttcttcctggggcctccggccttgcgaccggcggcgcccttcttccccttcccggtgg

SEQ ID NO: 6914 - DNA, 401 bp, Triticum aestivum
  Clone ID: LIB3281-045-P1-K1-G11
cggacgcgtggggtcgtcctcatccatggctctggctctgctgccgctactggtggcagccgcattcttcatcccctccatggcttcatcagcttcaggtaccctggaccatggcttggatggtgaggcactgctgatgctggggaggttccatgggtggatggcggcgcacggtcggtcgtacgccaccgtggaggagaagctgcaccggtttgaggtgtaccggagcaacatggagttcatcgaggcggcgaatcgggacagccggatgagctacagcctcggcgagaccccgttcaccgacctcacccacgacgagttcatggccatgtacagcagcaacgacgagtcgtcatgggagtcggaggagatgaccgtgatcacaactcgcgcttgccccg

SEQ ID NO: 6915 - DNA, 407 bp, Triticum aestivum
  Clone ID: LIB3281-045-P1-K1-G12
caacccccattgtcgcgcgccatgcgcaggccgacctccccccggcgctctgcccaactgccccaccttctccggcgcccccgccccgccctcgccgcctccccgcccgcgagcagcccgccttgcgacgcgctagccggaggggcactcgttccgcgccaacccaccagcgccgccatggtcccggccgccctcccgccccactcccgagcggcgcgtcctcgcggtggatatggacaaccaccacagcggcctcgcccgttcccctccttcccccgacgcccatggatccatggtggcacccccgcctcccgatgtgtgctggagcgaggtggccggcgagctgcctcctcccagcgtgggcaggctccatgggcaggggaagaacaatcgggggctgccgggct

SEQ ID NO: 6916 - DNA, 403 bp, Triticum aestivum
  Clone ID: LIB3281-045-P1-K1-G2
aggacttccgcgacccgaccaccgcgtggtacgacgagtccgacggcacgtggcgcaccatcatcggctccaagaacgactcggaccactccggcatcgtcttctcgtacaagaccaaggacttcatcagctacgagctgatgccggggtacatgtaccgcggccccaagggcaccggcgagtacgagtgcatcgacctctatgccgtcggcggggggcgcaaggccagcgacatgtacaactcgacggccgaggacgtgctctacgtgctcaaggagagcagcgacgacgaccggcacgactggtactcgctgggccggttcgacgccgccgccaacaagtggacgccgatcgacacggagctcgagctcggcgtcgggctgcggtacgactggggcaagta

SEQ ID NO: 6917 - DNA, 398 bp, Triticum aestivum
  Clone ID: LIB3281-045-P1-K1-G3
cggagccggaggaagagaggaagggagaagccaacaggtaacgatggtgtccggctccggtgtgtccgcgcgtcgcgtggtggtggatgcgcgccaccacatgctgggtcgccttgcgtcgatcgtggccaaggagctgctcaacgggcagcgcgtagtggttgtccggtgcgaggagatgtgcatctccggcggactggtccgtcagaagatgaagtacctccgcttcctccgcaagcggatgaacaccaagccctcgcacggccccatccacttccgcgccccctcgcgcattttctggcgcaccgtgcgcggcatgatcccgcacaagacgccccgcggcgaggccgcgctcgccaggctcaaggctttcgagggcgtcccgccgccttacgatc

SEQ ID NO: 6918 - DNA, 359 bp, Triticum aestivum
  Clone ID: LIB3281-045-P1-K1-G4
ctcacccaaatctctggtggtttcgggatctcgcatgggttgatggcgtgctcaagtttattgagatggagaatcttgctcctgaaagccagagcgacaagggtgatgttatctacgattcagacttgatcatgtcgctcgagcgcaaggccgtggattggcattgcaagcagctgtccattgggggtgcctggagggctgtgacatggactcggacagtttcgtccaactgttggcgccagacatgtgctgccaatgtcgctgacatcttggttgtcgacggatcagcacattcatctttgttgcccgggttaaagggcgaaaagttgacattcagggacctctactcagctttccca

SEQ ID NO: 6919 - DNA, 403 bp, Triticum aestivum
  Clone ID: LIB3281-045-P1-K1-G5
ctcacccaaatctctggtggtttcgggatctcgcatgggttgatggcgtgctcaagtttattgagatggagaatcttgctcctgaaagccagagcgacaagggtgatgttatctacgattcagacttgatcatgtcgctcgagcgcaaggccgtggattggcattgcaagcagctgtccattgggggtgcctggagggctgtgacatggactcggacagtttcgtccaactgttggcgccagacatgtgctgccaatgtcgctgacatcttggttgtcgacggatcagcacattcatctttgttgcccgggttaaagggcgaaaagttgacattcagggacctctactcagctttccccatcctgagcccggatggtgacgatattctttatctcaaatcaat

SEQ ID NO: 6920 - DNA, 410 bp, Triticum aestivum
  Clone ID: LIB3281-045-P1-K1-G6
cggacgcgtgggaggagagcggcggcgaagatggcgtcgctgaagctgcagaagcgcctggcctcgagcgtactcaagtgtggcaagggcaaggtctggctcgaccccaatgaggtcaacgagatctccatggccaactcccggcagaacatccggaagctggtaaaggatggtctcatcatcaggaagcctcagacgatccactccaggtctcgtgcaaggagggcacatgacgccaagcagaaaggccgtcactctggatatggtcagcgtaggggtaccagggaggctaggctccccaccaaaatcctgtggatgcggatgatgcccgtactgaggcgccttctgcgcaagtaccgtgaggccaagaagatctacatgcacatgtaccatgacatgtacctgaaggt

SEQ ID NO: 6921 - DNA, 395 bp, Triticum aestivum
  Clone ID: LIB3281-045-P1-K1-G7
aatttgttgaacaagttttgcctaattttatttcttgcatctcctgtggtaagttttatttcttggtacttgtaaaattgttcagattacttagcttcgttcaactgctgtgttgtctaaatctactgtgcctataaacatacgtgcttgcccgtgaccatgtcggctatgttgttattctttcttgaattggtaggttgaaaccaagagggcattgtaaactttgatgacactttgtgggaaaccaattacttcatggccagaggtgattttggaatggagatttcagttgagaagatattccttgcacagaaaatgatgatctacaagtgcaaccttgctggtgagcctgttgtcacagcgattgtaggcaccatccattccaattgtccatt

SEQ ID NO: 6922 - DNA, 225 bp, Triticum aestivum
  Clone ID: LIB3281-045-P1-K1-G8
aatacgctgaacaagtttggccttattttatcgcttgcatttactgtgggagggtgtatatcggggggcgtgtaaaattgttcaaatgacttagcttcgttcaactgctgtgtagactaaatctactgtgcctttaaacatacctgcttgcccgtgaccttgtaagctatgatgtcattctttcttgccttggaaggctgaaacctagacggcatccgttaactt

SEQ ID NO: 6923 - DNA, 402 bp, Triticum aestivum
  Clone ID: LIB3281-045-P1-K1-H1
cggacgcgtgggccacctatctgcccccgccgccgccacgcccaccgccgacgacgatggcaactactgcctcaccctccaccacgaccaccccccggtccttcctctcgtcgccttcctcctcactcagggcatcgaagtcgaaccacctccggacgacgagaaggctgcccgttaatgtacgctgcgccagtagctctccggccgccgatacatcttacacgactaaggtttcgcggaatgccaacatagccaagctccaagcaggctatttgtttccggagattgccagaagaagggcagctcatctgctgaagcatcctgacgccaaaattataagtctgggaataggtgacactactgagcccatcccggaggtcataacaaatgccatggcagaga

SEQ ID NO: 6924 - DNA, 226 bp, Triticum aestivum
  Clone ID: LIB3281-045-P1-K1-H10
cgacaccctggcgtggccgttggactccaaggtgcatgaggcgttcgggggggtcgttgcgaggctggagatcatttacaagcacgcggtggccatgaacgggtacccgcggttcatgaaccgcaccgacccggccatgttcccctacattttattcttccctaactctttttaccacactttccaggccgtggtgctcacggtcatgtgcattcctaacagcatc

SEQ ID NO: 6925 - DNA, 349 bp, Triticum aestivum
  Clone ID: LIB3281-045-P1-K1-H11
gcagcaggaggagagccggcaggccatcgggtccccggcgcggtcggcggaggaggagatggagcgggtcttccgcaagttcgacgccaacggcgacggccggatctcgcggccggagctggccgccctcttcgagagcctgggccacgcggccaccgaggacgagctgacccgcatgatggccgaggcggacgcggacggcgacggcttcatcagcctggaggagttcgcggcgctcaacgccacggcgcccggcgacgacgaggaggacctgcggctcgccttcaaggtgttcgacgcggacggcagcggcgacatctcggccgcggagctggcgcgcgtgctccac

SEQ ID NO: 6926 - DNA, 289 bp, Triticum aestivum
  Clone ID: LIB3281-045-P1-K1-H2
cggacgcgtgggacacgtatgtgatctgggcgaagacgcgcctactgacgacggcgacggatactactggctaacactacaataggaccaccgcctataccttgctgttgtggactgtgtccttactcagggcatgagaagtcgaacgacctccggtcgacgagaaggcaggcctataatgtacactggggcagaagctcttgggccgtcgatacattttacaagactaaggacaagcggaatgcgcaacataatcaagctacaagcatgctatgatggttacggagat

SEQ ID NO: 6927 - DNA, 351 bp, Triticum aestivum
  Clone ID: LIB3281-045-P1-K1-H3
gaaggatgttccacaagaaagttatctgggcaaagaggagcctactgacactggtgccgtatgccagcaggtactacttttattgtctgtccgcctatagtctgctgatgtgcgatgtgcctcttcgtccggtcgactatgccttgattgtggttggagcccagtggatggctagcgatgaaatgaggggaaaattcctggagtcatacaattacttcaagaatggtggcaaaaaggtggatgctggtgatgctggcaagaagatttgaggctcttcttcctctggttcttggtgtagttcaattgagatgctccaactcttgcccactgttactgtgtgtcgtgttttgt

SEQ ID NO: 6928 - DNA, 429 bp, Triticum aestivum
  Clone ID: LIB3281-045-P1-K1-H4
agcaaggaagaggaagaggaagcggatcgagtcggcgagagcgagggcgaggacgatggcggcgctccggctagcgttgaggaggttttgcgaccgtgcgctcgggagatcagcgggcatttacgagctcaaggctgccaaggaattccccgacattgatcctgggcatctcaaggctgccaggaaattccccaaacttcgtgtcaaggatgccgatgctacggctctgaatgtcttcaagattctccgggacagtccagtcgatggtcataaagatgtaacccttcgtgaagtgcgcatgactctgaggaccttggctgagattcaggaagaagaagaatgaagatggcgctactaggaagcaatatcgtctcttgctctaatatgaactagctttgcagtattgtagtatttgaatctttcctatgg

SEQ ID NO: 6929 - DNA, 429 bp, Triticum aestivum; identical to SEQ ID NO: 6928
  Clone ID: LIB3281-045-P1-K1-H5

SEQ ID NO: 6930 - DNA, 399 bp, Triticum aestivum
  Clone ID: LIB3281-045-P1-K1-H6
cagcggcccagctacacgagaggagcgcggtagtcctttcccggcgcgcagcggtgcactatggcgtccaccggagccgtcccctgctccgtcctcctgctcctcctcctctgcgcgtccccgctgtgccagggccaggccggacggcacaacatcacggagaccctcgccgccgccagcccggacttcgcccagttcagcgccgccctggccgccgcgaacctcagcgccgagatcgacgggcgcagccccgtcaccgtcctcgccgtcgacaacgccgccgtggcgcggctcggggagcggcgcctccagccggacgccctcgcgcgcgtgctctccctgcacgtcctcctcgactacctcggcgacgccaggctccgtaccctcgacggcgggttc

SEQ ID NO: 6931 - DNA, 392 bp, Triticum aestivum
  Clone ID: LIB3281-045-P1-K1-H7
cctccactcctcccgattccgatctgcgtcaagcgtgaggcgagatttctgcggcgatccgctcggtctcacgccggctggccacagccggagccgtccacggtgcgcagggtggtacccttgctgtcgccgccccagttcgtcgcccggtgataaccctccctgcccgtggctattctgcttcgtctgcagggattacttcaattgctaaggagactggccagaggttgtacaaagctgttcttcggtccaccccattcatggcatcagtcaccacctatgcaactgtggtttcggcagttggatactgggtcattgagactgttgagggtggagtgaataagaagcttgttgagcagaataacactctcgccgtgaagcttgaagcggag

SEQ ID NO: 6932 - DNA, 401 bp, Triticum aestivum
  unsure (1)...(401): unsure at all n locations
  Clone ID: LIB3281-045-P1-K1-H8
cccacgcgtccgcacctccgtcgagtccctcggcatgacgtgggggtacatggggacgcacgacgccgagacggcggagtacttccgcggcaccgacgtgcagtgcgtcctctgcccgcggaatcccgacatcggcagaagcgccgtcatgggcttgcagactgcctacatgatcagccaccaccagaagatcatcgcggttgaccacgacatgccggtgaggggcagctcgagccgccgccgcatcgtcagcttcgtcggcggcctcgacctctgcgacggtcgctacgacacgcagttccactccctgttcaggacgatggacacggcgcaccacaaggacttccaccaacccaattttgtcgacacgtncataaccaagggcggcccgagggagccat

SEQ ID NO: 6933 - DNA, 375 bp, Triticum aestivum
  Clone ID: LIB3281-045-P1-K1-H9
cggacgcgtgggctgacgcgtgggcttgagcctggcaccatggacagtgtccgtactggcccttacgggcagatcttccgccctgacaacttcgtctttgggcaatgtggtgcgggtaacaattgggccaagggccactacaccgagggtgctgagcttatcgattctgttttggatgttgtgaggaaggaggctgagaactgtgactgtctgcaaggattccaagtgtgccactctctggggggaggtaccgggtttggcatgggtaccctgttgatatctaaaatcagggaggagtaccctgaccgcatgatgctgacgttctcagtgttccccttaccaaaagcatctgatactgtgtgtgagccatacaat

SEQ ID NO: 6934 - DNA, 346 bp, Triticum aestivum
  Clone ID: LIB3281-046-P1-K1-A1
gtctgccaggccctgctccacgacgccagcaaatgcatgccgtgctcacataagttctgcaaggcgtgcatatcacgctttaaggactgcccattgtgcggtgctgacatagaggggatcgagccggataccgagctccaggcccttgtcgatcgcttcattgacggtcatgcccgaatcaagagatcgcttgctggagaaagcaaggaagcagcggatggcaagagcaaagtgatatacgaggatgtctccatggagagaggtgcttttctagtgcaacaagccatgagggcttttcgcgcacagaacattgaaagtgcaaagtcgaggctcagtatgtgtgcag

SEQ ID NO: 6935 - DNA, 374 bp, Triticum aestivum
  Clone ID: LIB3281-046-P1-K1-A10
ctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattac

SEQ ID NO: 6936 - DNA, 368 bp, Triticum aestivum
  Clone ID: LIB3281-046-P1-K1-A11
ctccccactcccaccagtgtctgtctccccacaccgagctcagtgagcgagccccagcagccgccgccggagccggagctgctcgagactcgacgccgatggccgggttcgccacctcgcggccggcctccctcgcgctctgcggcttcctcatcttcctcaacgtcttcgccttcctcctcgccgtcggcgccgagcagcgacgcagcaccggcaaggtggtgccggacgagtacgacgagcggtcctactgcctctacgacacggacgcctccaccgtgtacggcgtctgcgccttcttcgtgctcctcctggcgcagctgctggtcaccggcgtcacccgctgcctctgcttcggccccgcgctc

SEQ ID NO: 6937 - DNA, 352 bp, Triticum aestivum
  Clone ID: LIB3281-046-P1-K1-A12
cgtactcgtgggcggacgcgtgggggctgtccttcttgacaattatgccatctataacatcttactctcatcaataatatttttatttatataaataactcttttattaattattttttattttttaaaatcttataattaatattattttatcataattattttaaatttttttatatcattaatattattaatatttttatattttataaaaaattctttttctttataaaattttattatactatcctttttatttttttttaaaaattaattataatattatattttatttttatttttattattctttatctttaattttattttattaatatttcaaaatttttta

SEQ ID NO: 6938 - DNA, 109 bp, Triticum aestivum
  Clone ID: LIB3281-046-P1-K1-A2
tagccaacgtggtgaagctcgtattggacataatccattcgggggctgatatactgtactttttatactgattggttgggtttcttattcagatgaacttgtttttttt

SEQ ID NO: 6939 - DNA, 382 bp, Triticum aestivum
  unsure (1)...(382): unsure at all n locations
  Clone ID: LIB3281-046-P1-K1-A3
ccggctcttcaaacccgcagcagagagacgaggtagagagagcgagagagagagagaggtagtagtaggcagccgttgcttgctggcctagctagctgctgctgcggcgtgcttggctctggcgggcatctagatgctctcatttcctttcgcggcagctgctcccctacgccggaatccctccgtctccgtgccttccctccctcctctcatggcctagattcgtgccagtgctgctcgtagcaatcaatcgggagccgtttctttcttctttcctcgcgcctagtacgtagcgtagcctgctctgctgcggcctgcgcgctttgaatacgcgccctcctnctcaaaacgctcaaaccttgtccctttcccgcaaacccct

SEQ ID NO: 6940 - DNA, 385 bp, Triticum aestivum
  Clone ID: LIB3281-046-P1-K1-A5
cggacgcgtggggagaaatttctttcctactttaaaccctgtattataccagaggaaggtggaattgcatctggtttcaggcacactgaaatcaatgaacgggagcatgtaacacgattatttgtctgcagaggaaagcatacagtccatgtcaaagaggttccttttgcaagatcatcactcaaccatgatgacatatttattttagatacaaagtccaagatattccaattcaatggatcgaattctagtattcaagagagggctaaagcccttgaggttgtgcaatatctcaaagacaccaaccatgaaggaaaatgtgatgtagctgcagttgaggatggaaagttgatggcagacgctgatgctggtgaattctggggtc

SEQ ID NO: 6941 - DNA, 387 bp, Triticum aestivum
  Clone ID: LIB3281-046-P1-K1-A6
ggcctcacaattacctactccgccgccccccgacgccgacgaccctccgtcggccccgaactccgacgcccctccgtcgcctccacagctccaggtctccctcccaaacgatatcctggaggagatcctcctccgcctctccaccgcggccgacctcgcccgcgcctccacctcctgcacctcatttcgccacgtcgtcgctccccgctccttcgcgcgccgctaccgctccctccacaaggtccccgtgctcggcttcctccgtgctgacttctacgccgcccagtctccgcacccctccgccccggccgccaacgccctcgcgcaggctgccgacttcgccttcagcttcctccccaaccccgcctgctggagcccccgtgacgt

SEQ ID NO: 6942 - DNA, 369 bp, Triticum aestivum
  Clone ID: LIB3281-046-P1-K1-A7
cttgatgagattgatgctatcattagccaacgtggtgaagctcgtagtgaacatgaagccagtcggcgactgaagactgaactattaatacagatggatgggttgactaagacagatgagcttgtttttgttctggcggccacaaatttaccatgggaactagatgcagcaatgttacgccgattggaaaaacgtattcttgtgcccttaccagaggcagaagctaggcatgctatgtttgaagagttccttccatcgactccagacacaatgaagattccatatgatgttcttgtggagaacactgaaggatattccggctctgatatacgccttgtttgtaaggaggcagcaatgcaaccacttaga

SEQ ID NO: 6943 - DNA, 283 bp, Triticum aestivum
  Clone ID: LIB3281-046-P1-K1-A8
gtagggaaactgtacagctcttgcgtacatgtgctaagaatagtgttcttggctttgcagtgatcagcagatcgaggctatctcaacatatctcccacttggacaagtctgacctcaacacattcttcccaaagttcataaaaacactcacacttgcattccttattcctcagcatccaagcaaccattccctcttccagatcatacatttttttgcggttcttattcgcggtactgtttttttgcagggcatggcttgagcagaacgggggccggggttgat

SEQ ID NO: 6944 - DNA, 371 bp, Triticum aestivum
  Clone ID: LIB3281-046-P1-K1-A9
cggacgcgtggggtgggaacctgctttctggggaattagctattttgcgttcttgggatggcatagtggaggtgattgacttgagttcaaacaagctggaggggagctacccgaatgatgcccctcagtttcagaacttagttaccctgaagttgcggaacaattcgttgaagggatctgtcccttcagtgttgggaacctatcaaaagctatctttccttgatctcagtttgaatgcacttggtggccctgttttgcctgtttttattctgtcgcctactcttacagtgttgaacctttctggaaacaacttctatgggactattccatttcagagccctcattcaacagagtccataatgctatcttct

SEQ ID NO: 6945 - DNA, 387 bp, Triticum aestivum
  Clone ID: LIB3281-046-P1-K1-B1
acgcggacgcgtggggccacgagttggacacgcccacttccagtgacctgcctccccacagatatgacatttgttgggatcgctccactccatgcgctcagtgactgcaaatgtcgaagacggcacagccttcatgtctgcatgctcaagagatagccgcacctcctcttgagacatagcagcaatagtctcctcaatagagggcaggagaggttggtgcaacagggatgccctcctgccatgaaaacaacctctaagcccctccaacagtttcagcacacgcctgcgtgcaatccacttgcgccctgactcgatgcaagccgcatcgtaaagttccagagggtcgcagttatcctgctctgcccacaaagcctgcagctctgccac

SEQ ID NO: 6946 - DNA, 380 bp, Triticum aestivum
  Clone ID: LIB3281-046-P1-K1-B10
ctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactac

SEQ ID NO: 6947 - DNA, 379 bp, Triticum aestivum
  Clone ID: LIB3281-046-P1-K1-B11
cccacgcgtccgctcaccgtcctctcctctcccctgccgccgccgcgcccccgctttccccaccgcgccccgcaaaccctacccctcctcctcgctccccggcccgccgcccgccgcccgccgcgtcgccatgagtcgtcaacctgaggtgctctgggctcaacgtgcggaaaaggtttacctgactatctcagtcccagacgcagaagatgttgtgatcaagactgaacctcagggcatctttagcttctcagctgttgctcatggggaatcttttagcttggccttggagctattcgattccgtactgcctgagggaagcaaaacaaagacaaaggtgggttcgcgaaacataatctgttcgatccagaaagataag

SEQ ID NO: 6948 - DNA, 373 bp, Triticum aestivum
  Clone ID: LIB3281-046-P1-K1-B12
cccacgcgtccgcggacgcgtggggagcaagaagggttggaaggcggcggcaggatagaggagaggagtcagaagatggctccggtgaagaagcccaaaaaggccaagcggaagatcagtgactccggcgagaccaagatcgatgactccagcgaggcgaagaccaaggacgccagcaaggtcaagagaaccaagtccggcggctcgttggcgttgcttccggcggaccttcgtggccccgatacggaatggtggtatgtcttcctcagcaagcacggggaactccacaaggaagccgaatcaggtggtcgtgctccagtgccttcagatgatgaggaagcgttcaggtacttcttcaggacatcgaggagga

SEQ ID NO: 6949 - DNA, 394 bp, Triticum aestivum
  Clone ID: LIB3281-046-P1-K1-B2
acgcgtgacgcacgcatctggggacgcgtgggctgcttccccggcttcttctccactcgatccaagccatttgtgccttctccaagctccactttttctcttggaggatggagggggcaaagaagcaggttttcacgatcaaggtggaggatgggaagcccgggaaggacggccggccggcggtggggccggtgttccggaacatactggccaaggatgggttcccgccgcttgatcctgacatgaggacctcatgggatgtgttcagaacggcagcaggcaagtatccaaacaaccggatgcttggatggcgtccatttaaagacggagtgccagggccctacttatggaaatcatacaaggaggtctatgaggaagtcctgcaaattggatc

SEQ ID NO: 6950 - DNA, 364 bp, Triticum aestivum
  Clone ID: LIB3281-046-P1-K1-B3
gcaccgcccagcccgcgcacaagagcatcctaaccctagttcggcgacgactcggcgcgcggcggcggttggttcggagccgacgagggccactcggggcacgcgaagggagcgcagccgccggcctccgccgtggttgctcgcggcatcggcgaggacgatctcctcgagggtttcgcagcccaggtaacccggaatcaaacatttcatcctcagacaaacttcccttgttgctatggaatccaagttctttcagttcctgaagcttgtcggagttggtttcaaagcaaggacagagcaaggaggccgcgagttgtttctgaaactaggttacagccatgaggtgcagttcactgctccaccc

SEQ ID NO: 6951 - DNA, 389 bp, Triticum aestivum
  Clone ID: LIB3281-046-P1-K1-B4
gtccgccaaggacagcaagcaagactgcaggcaaaacatcaccatccaaaggttccaaggaaaaggagagccctgatgagagtgcaaaggtcttctctaggaagaagaaacccatcatatcaaagcatactccaagctctgaaaaggtgatagaagaaaataagtcatcaggtaaagaggcaatgaagagcaaaggcgaatcagcagaagggggtctgcccagtaaggctgagttgaagaagaccattatcggaatccttaaaaaagttgacttcaacacgtctacttttagcgacattcttaagaagctcgatgaccattacaagattgatctgaccgcaagaaaaggagctatcaaaattatgattcaagaagagctgacaaagtta

SEQ ID NO: 6952 - DNA, 377 bp, Triticum aestivum
  unsure (1)...(377): unsure at all n locations
  Clone ID: LIB3281-046-P1-K1-B5
cccacgcgtccggcggccggcccgcctaactctcaccttgccgctgcgggacgcttgctccgccccgaagcttcccttccccgatcctccgccgcggctgtttccgtcgccggtcaagatgatgtccggcggtggctactccgccctcgacgatcccaaggcctccggatccgtcccggcggcgacggggccagatccgcagaccatcaagttcactgagtccaacctccagaccttcccacccttagaagccaagggcaagatctttggcgcctaccgnccgcccactgacttcgacgacaccttcttgtccaaggttggagggggcggcggaagcaggggtagcgatggtgggtcggacgatgccgcgcagggcg

SEQ ID NO: 6953 - DNA, 342 bp, Triticum aestivum
  unsure (1)...(342): unsure at all n locations
  Clone ID: LIB3281-046-P1-K1-B6
ttctagcgttctntgtctcttttttttttgtttttccttgtttgtttctggttttttggtttttttttatttcttgttcttttcttttttttatttttttttatttctttttttttttttatttttttttttgttattttttttttctatttttttttttttttttttttttttttttttttttatttttttttttttttttttttttcttttttttttttgtttatttttttttttttttttttttttttttttttgtttttttttttttctcttttttttttttttttttttttttttttttttgtatttttttttttatagttttttattttctttttt

SEQ ID NO: 6954 - DNA, 372 bp, Triticum aestivum
  Clone ID: LIB3281-046-P1-K1-B7
cggacgcgtgggctgcttccccggcttcttctccactcgatccaagccatttgtgccttctccaagctccacttcttctcttggaggatggagggggcaaagaagcaggttttcacgatcaaggtggaggatgggaagcccgggaaggacggccggccggcggtggggccggtgttccggaacatactggccaaggatgggttcccgccgcttgatcctgacatgaggacctcatgggatgtgttcagaacggcagcaggcaagtatccagacaaccggatgcttggatggcgtccatttaaagacggagtgccagggccctacttatggaaatcatacaaggaggtctatgaggaagtcctgcaaattgga

SEQ ID NO: 6955 - DNA, 373 bp, Triticum aestivum
  Clone ID: LIB3281-046-P1-K1-B8
cccatattttttagcttgaaggaggctttcttgatgccattcaccactgtatcttcaaaaatacattgccaaggattgcttcctctttatcctgttacatcgtccgatgccttgtcatcaaccagtactccagcatcaattgcgttctataaggtttatgttctctttggtgatttcttccaacaaactaatggtcctgatgtgaacatactcattgcttatttccatgtttttctttaacttattctgtacatgctttgcattgagtccgtgatctgtcacttttcagagtcctaactgattactcaaaatagcaggataaagattctcagcataatgcttcttcatatagctcgactgactacatatgctt

SEQ ID NO: 6956 - DNA, 379 bp, Triticum aestivum
  Clone ID: LIB3281-046-P1-K1-B9
caataaaagcgtcctttatagagagaaaaaatctgtttcccacaaaccgaagaccgaataaatgtaataaaaatatctttaccaacacaaatgtaaggatggtccaaacaatatatctacgacaattttccatcccaacacaattatcggtagggatgagtaaacatcacaaaaaacaaaaataaagaacatgtcaaactgcacaaataatctagtaacattggtgtgtttccacacgatgaatcgacaagagtgaaaggaaaaagtcaccacaaaaaggctggttgcgccatgttgtgctatcgcatcgcggctccctcacacataaggagctcttgcttggcctgcattgaggcggccgtggccatgtctgtgccgc

SEQ ID NO: 6957 - DNA, 388 bp, Triticum aestivum
  Clone ID: LIB3281-046-P1-K1-C1
ggcatggccaagtactacccgccggagtggctcgagcagaagaagagggagcacgcacaagacgccgcgtatttcgggaagattgacgccgactacgaggacttccggaagaaggtgatcgacggggtcaaggagaagggctacttcgaggtcgacgagggctacatggagaagaagcccgatcaacacccaaagccacaactgcagaaggtcgatttaagtgaactcatgcgctttgctgctacccctgaagaagagttgcggcggcgaggtggtaatggttatcatgagtactctactgatgaagaggatgatgctgttctggctcatgtgcgtgatgaagacgatgatgatgactttctgagtgattcttctgtgagcgatgagg

SEQ ID NO: 6958 - DNA, 377 bp, Triticum aestivum
  Clone ID: LIB3281-046-P1-K1-C10
cggacgcgtgggaggagaccttccgctcctccgccatgctcaacatgctctccatctccttcggcgtcgccatcgccgcctacggcgaggcccgcttcgacctccgcggggtcgcgctccagctagccgccgtcgccttcgaggccaccaggctcgtcctcatccagatcctcctcacctccaaggggatctcgctcaaccccatcacctcgctctactacgtcgcgccctgctgcctggggttcctcttcctgccctgggtcttcgtcgagctgcccaggctgcgcgccgtcggcatgttcgagcccgacttcttcgtcttcggcaccaactccctctgcgccttcgcgctcaacctggccgtcttcctgctcgtc

SEQ ID NO: 6959 - DNA, 372 bp, Triticum aestivum
  unsure (1)...(372): unsure at all n locations
  Clone ID: LIB3281-046-P1-K1-C11
ggcgtcgagcaccagctcaacgaccgcgtcatccgcggcgcccccatggaccgccactcccgcttctggaagggcgccgacgtcctcgtcttcaactcctacctctggtggatgaccggcgacaagatccagatcctgaggggtgccgacaacgacatgagcaaggacatcgtggagatgggggcggaggaggcctacaggctggtgctgcaccaggtggtccggtggctggacggcaacgtggaccccaagaagtcccgggtcttcttcgtcacggcatcgcccacgcacgccagcggacagctctggggcgacgaggcggagggcagcaactgccacgcccagaccaagcccatcgccgacgcgtnctac

SEQ ID NO: 6960 - DNA, 361 bp, Triticum aestivum
  Clone ID: LIB3281-046-P1-K1-C12
cggacgcgtgggcgaaacgaacggaatgaaacagagcatcacgttcgagaacttcatcatccaggccggcacggacgcgtcgctggtgccgacggacatggccaccaccaacgccaccgtcaagttcacctacaagaacaccggcaccttcttcggcatccacgtcaccgccgaccccttcacgctctcctactcccagctcaacctcgccgccggagacctcaagaagttctaccaggggcggagcgggcggcggacggcgagcgtgaacgtcaaggggaacaaggtgccgctgtacggcagcgggccgacgctgatggcgcagcccgcggggggcaagggcggcgccggcaaggtgatc

SEQ ID NO: 6961 - DNA, 365 bp, Triticum aestivum
  Clone ID: LIB3281-046-P1-K1-C2
cccacgcgtccggttactccaagagcctggctcttatgttggtgaggtggtgaaggtcatgggcaaatcaaaggttctagttaaggtgcatccagaaggaaaatatgtagtagatattgataagagcatcgatatcacaaaaatcacaccttcaacaagagttgctcttcggaatgatagctatatgcttcatttggtccttccaagcaaagttgatccactggtcaatcttatgaaagttgagaaggtcccagattctacatatgatatgattggaggtcttgatcagcaaatcaaggagatcaaagaggtcattgagcttcctatcaaacatcctgagttatttgagagccttggaattgcgc

SEQ ID NO: 6962 - DNA, 372 bp, Triticum aestivum
  Clone ID: LIB3281-046-P1-K1-C3
cggacgcgtgggcagatccacagagcggcagagagatcgccggagtatcaggccgaggaagaagtcttcagccagccggatctcaagtcagtcaccatggtggtcgcgctcggccccggcaggttctacggcggcggcctcccgcgcccgcgcgtcttccccggcgaccgcgtcgacccgccggcgcccgtcaccgacgcgctcctctgctgggcgcgcgacgcgcactggtccatgggcggcctcggcgccaagcgccttcgcctgcagggccgcatcgagggcaacctcgttaagctccgccgcaccgcgcgccgcgacgctcgggtctccgccaagtccgccaaggccaaggtccgcgctgcggggcac

SEQ ID NO: 6963 - DNA, 381 bp, Triticum aestivum
  Clone ID: LIB3281-046-P1-K1-C4
cggacgcgtgggccacagtccaactacccatcctctcctcccgagtcccgagtctgcagccaaagcagagcaccacccagccgccgccggaagagcacgaggagatgggctccgggacggggaaggtggtgtgcgtcaccggcggctcgggctacatcgcctcctggctcgtcaagttcctcctccagcgcggctacaccgtccgcgccaccgtcagggacaccgccgaccccaagaaaacattgcacctgcaggccctggatggagccaaggacaggctgcacttgttcaaagcaagcttgttggaagaaggctctttcgatgctgccgttgccggctgcgattgtgtcttccacacggcttctcccttttatcacaatg

SEQ ID NO: 6964 - DNA, 378 bp, Triticum aestivum
  Clone ID: LIB3281-046-P1-K1-C5
cccacgcgtccggcaagactgatgtccatgtaaaaagctgcacgacaagtgtaccatccagaacaaaagttcagcaccgaaagaagaagaatgtggaattctctgccgtctatatggctcaagaaatccgggcgcacaacggtttaattagagtgatgaagtttagtccgtctggctggtatttagcaagtggtggtgaggactgtgttgtgagaatatggcagattacagaagtggatgcacattctaaaatgtatgggggagagaaccaccctcatgagcatgtagagaaaatcaaaatccttaagccgaagctagcagaggggcagagccgtgcacttgcagttatgccaagcaagggttttcacattacagaga

SEQ ID NO: 6965 - DNA, 375 bp, Triticum aestivum
  Clone ID: LIB3281-046-P1-K1-C8
cccacgcgtccgttcgatcgcaagcagcagcctgtccaccctcgcagccagccgctgtcgagagcggggcggtcgtcaccgccggctgctctctgccacgccgcttcgaccaggtgagatggaaggtttcgagttcttccagatcatacttgacaactcctcgagcaggctgaggctgcctgacaagtttaccagggtgctactagacggcggcaagccccaggaagtgaagctacgggaggccggtcataggcgtcgcttctgggacgtgaaggtggtgctggacgccgacggccacatgtacctagggcgcggctgggagcagttcgcccgtgcgcacggcctgcggctcggctacttcctcgtcttcagcta

SEQ ID NO: 6966 - DNA, 377 bp, Triticum aestivum
  Clone ID: LIB3281-046-P1-K1-C9
cggacgcgtgggcggacgcgtgggtctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacataaatatcccttcatggttttccttcaactcaaaagatggagttaatgttgttagtggagactcgttagtcgaatgtgctaaaattgctaatgaatgtgcaaaggttggtgcagttggtataaactgcacacctccaagatttattcatagcttgatactctccattcggaagtcacagac

SEQ ID NO: 6967 - DNA, 383 bp, Triticum aestivum
  Clone ID: LIB3281-046-P1-K1-D1
cccacgcgtccgaaatatttatacaatggttgatgttcttctgcatcatatccagcttgagcttcaacgggggcatctagtgcaggatttactttccaaagcaatcacgaatcttgcattctttgtatggacacatgagttagttccactggacattgtgctgctagctcttattgacagggatgatgatccttatgctttacgtcttgtgataagtctgcttgaaagatctgaacttcagcacagaattaaagcattctgcagttctcgttctcctgagcattggctaaaaaatcaacctccaaaaagagctgagctccagaaagctcttggtaaccatctttcatggaaggaccgctatcctccctttttcgatgacattg

SEQ ID NO: 6968 - DNA, 375 bp, Triticum aestivum
  Clone ID: LIB3281-046-P1-K1-D10
ctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatgggaagggaggatgttatgacgaaaaatgt

SEQ ID NO: 6969 - DNA, 349 bp, Triticum aestivum
  Clone ID: LIB3281-046-P1-K1-D11
gattaccaatcaaaaagtgtgcatttcatagtaaaaatctcacaaactgacaagcacagcatgaatcaaaatgaaccttcacaatggaaacaagattctcagagcatttaggtagaacagctcattgtgcataacgaaattatagctaaacagaaccaaatactagatatataactggttcaaaacaagggagacagctagatggacatgccaccagatggtccgtactgaattctttcaaagtagaaagcggcataactcatttaagaggaatgaaccgggaagagtgtgtggcaccaataccgggcctaccatgcttcactggcttgtaagagatagagaactctgc

SEQ ID NO: 6970 - DNA, 207 bp, Triticum aestivum
  Clone ID: LIB3281-046-P1-K1-D12
cggacgcgtgggctaatctatcctgatgaactagaactatacgttacttgtctctataactcaccccgtcacttttacttaatacttttccactgaacattacaccactaactctatacaacatgtcatcttcacactcactatttctttattatgctttcaccttgcttcttcccctttatctttataactacgcgctgcaccttc

SEQ ID NO: 6971 - DNA, 383 bp, Triticum aestivum
  Clone ID: LIB3281-046-P1-K1-D2
gagtctcctgaaagttgcaacctctccctctcggcgaatttggggtttctgaggcgcgcgaggtaaaccaaggttttgctcatggctcgtactaagcagaccgctcgtaagtccactggaggaaaggctccaaggaagcagctagccaccaaggctgcccgtaagtctgctcccactactggaggagtgaagaagcctcaccgttaccgccctggaactgttgctcttcgtgagatccgcaagtaccagaagagcacggagctgctcatcaggaagcttccattccagaggcttgttagggagattgcccaggacttcaagactgacctccgcttccagagccatgcggtgctggcccttcaggaggctgcagaggcctacct

SEQ ID NO: 6972 - DNA, 385 bp, Triticum aestivum
  Clone ID: LIB3281-046-P1-K1-D4
cccacgcgtccggattttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtatgacaccgtcgccgcggctgttgctccaaggttccctggccagtcctctggggtgagtgcatcatcggctcctgctgcagctgctcctgccgcttccaaggatgaagacgaggatgatgacatggatct

SEQ ID NO: 6973 - DNA, 387 bp, Triticum aestivum
  Clone ID: LIB3281-046-P1-K1-D5
cgccgaaccccagcccctaccccgcagccgccgccgccatggccaccaccgcgcgcccgctcgtctccgtcaaggccctggacggggacatggccaccgacgcggccggcgtcccgatgccgcacgtcatgaaggcgccgatccgccccgacgtcattaccttcgtccacaggctcgtctcctgcaacagccgccagccctacgccgtctcccgcaaggccggtcaccagacctcggccgagtcctggggcacgggtcgcgccgtctcgcgtatcccgcgtgtcggcggcggcggtacccaccgcgccgggcagggagccttcggcaacatgtgccgtggcggacgcatgttcgcgcccacccggatctggcgcaagtggcaccgtc

SEQ ID NO: 6974 - DNA, 347 bp, Triticum aestivum
  Clone ID: LIB3281-046-P1-K1-D6
cagtcgtcctgccccttctactgctcctactccggctttcaggatgagctgctctggggctcggcgtggctctaccgggcgaccaaggacggcaagtacctcgacttcctgcgccagaaccagggctccagcaacccggtcaacgagttcagctgggacaacaagcaggttggagcccagatgctcgcaacacaggagtatttgaaaggaaggagagagctagacaggtacaaggccaacctggactccttcgtctgcgccctcatgcctgacagcggcaatacgcagatactcacaacttgtggagggctcctcttcacacgcgattcagggaacatgcagtacac

SEQ ID NO: 6975 - DNA, 331 bp, Triticum aestivum
  Clone ID: LIB3281-046-P1-K1-D7
ctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccagtacctggacggccgcaacatcaccgtcaacggggcccagtcccgcc

SEQ ID NO: 6976 - DNA, 354 bp, Triticum aestivum
  Clone ID: LIB3281-046-P1-K1-D8
cggacgcgtgggcggacgcgtgggttcgacgtgtcgtccaagacaggcggcccgttcgggacgatgaagaagccggcggagcaggcgcacgccgccaacgcgggcctggacatcgccgtgcggatgctcgagcccatgaaggaggagatccccaccatctcctacgccgatctctaccagcttgcgggagttgtcgccgtggaggtctccggtgggcccgtgatccccttccacccagggagggaggacaagcctcagcccccacctgagggtcgcctccctgatgctaccaagggttctgaccacctaaggcaagtctttggcaagcagatgggcttgagtgatcaggatatt

SEQ ID NO: 6977 - DNA, 379 bp, Triticum aestivum
  Clone ID: LIB3281-046-P1-K1-E1
cagcaggcaagcaacaaaacaaagcaaatgaggcttaatgatgtctggataaggcctccatttggtggtcgtgggagaaagctgacaggaactcttgaggcccatgttaatggtttcagatattccacttcacgggctgatgagcgtgtggatatcatgtacgggaatataaaacatgctttcttccagccagcagagaaagaaatgattaccctccttcatttccatctgcacaaccatatcatggttggaaacaagaagacgaaggatgtccagttttatgttgaagtgatggatgttgttcaaactgttggtggcagcaggaggtcagcccttgatcctgatgagattgaagaagagcagcgtgagagggaccgga

SEQ ID NO: 6978 - DNA, 377 bp, Triticum aestivum
  Clone ID: LIB3281-046-P1-K1-E10
cggacgcgtgggcggacgcgtgggctctgtcctcggccactcgtcgttcgtcaaccctagccgccagcgacgaggccgtcccgacgccgccatctctcgtcgccggtgagcttcgtccggcgaccccgacaaccgtctggtcctcgagccgcccttccccggcaccgcgagtccgtccttctcccccgccgccccaacctgccagcagccgacccctgccgccggcgacgctgctattctcccccgccgtcgccactccagaaggtcaagcggcggcggcaaacgcggaggcggaggatccaagatgatcatcccggtccgctgcttcacctgcggcaaggtgatcgggaacaagtgggaccactacctcgatcttc

SEQ ID NO: 6979 - DNA, 198 bp, Triticum aestivum
  Clone ID: LIB3281-046-P1-K1-E11
gttgcagatggggaggcgtgcctttttttgttttttttggaccgaatcccgtcggcttataaaaaatcaatatagagtgcctgttttagtggtaacctgggaaaacgtttcttttttacaaagacccctttatatttgtaagaatacaacccgcgatcctttattttatcttatacagacgtcttctttccacccgcg

SEQ ID NO: 6980 - DNA, 378 bp, Triticum aestivum
  Clone ID: LIB3281-046-P1-K1-E12
cggacgcgtggggtaaggtgtactgctgggcttggactatgtgtttctgtttccagcagcttgccgagtcgttttactcaatacttgtggactgaaatttaagtcgttaagtttgtacaacatgtcgtgattacactttttatttgtagatgttgctattgccttgcttcttccgcagttttcttgagggcaaggcggggcgccgtctgtgcaggcgatggcagcaggagcggcggagcgccacgatacccgagcacaaccttggtcggaccgccccgcgacaccccacgcggagcgcggcggcggcgagcggtccgggagcccaaggaggcccttttgccagccagcgtgactgcgagagagtgcccgagctaccac

SEQ ID NO: 6981 - DNA, 143 bp, Triticum aestivum
  Clone ID: LIB3281-046-P1-K1-E2
cagacgcgtgggcagactcgtggtctgtctcgtggtcatgacgccttgaatttatcccgagctccggtgggaagggagcttttaggcggaccaccttgggactttggccgtaccggcttagtcaatggttcgggcccttgggg

SEQ ID NO: 6982 - DNA, 385 bp, Triticum aestivum
  Clone ID: LIB3281-046-P1-K1-E3
cggacgcgtgggcggacgcgtgggcgcgccagcccgcccgccgcctcacgcgctcctcccggaatcgcgcaccgccgccgccatctccgccctcgacaccaaccccttgctcgcagccacagcgtgaggcaggatgaggaagctcaagttccacgagaagaagctgctgaagaagaccaatttcctcctgtggaagcgggagggcggccaccgcgaggccgccgtcacgcagcgctacagcctcgtcgacagggacgactacaagaagtacaacgggatttgcttgatggcgcagaagctcgtgaacatcataaagcagatggatcccagggaccctttcagaatagagatgacggacatgctgatcgataagctgtataatatg

SEQ ID NO: 6983 - DNA, 217 bp, Triticum aestivum
  Clone ID: LIB3281-046-P1-K1-E4
cggacgcgtgggctgacgcgtgcgccctccagtccgtccgcctcctcacgcgctcctggtggaatctagcaccgccgtctccattttctccatcgacaccaaccccttgctcgcatccacagactgaggtaggatgaggaacctcaagttccacgagaagaatctgctgaagaagaccaatttcctcctgtggaagcgtgagggcggccaccttgag

SEQ ID NO: 6984 - DNA, 387 bp, Triticum aestivum
  Clone ID: LIB3281-046-P1-K1-E6
cggacgcgtgggcggacgcatgggctttttttttttttttaacaaaaacgaactttgctcccttgattcaaacagcaacatcactatttcttcaaacacacaggcagcacaatccttacaaatattgtaacatcgtactgccaactacatacagaacatcatcatcgattcgttaaaacgacgacgatgaagcctaggatgaggtgaacttggtgacggccttggtgccctcggagacggcgtgcttggcgagctcgccggggaggacgaggcggacggaggtctggatctcccgggacgtgatggtgggcttcttgttgtacctcgccagcttggcggactcgccggcgagcttctcgaagatgtcgttgatgaaggagttcatga

SEQ ID NO: 6985 - DNA, 349 bp, Triticum aestivum
  Clone ID: LIB3281-046-P1-K1-E7
cccacgcgtccgcggacgcgtgggggtggtggtccgtcccaccccacgcccggcgggaccgccgatgtcgccccgttcctcggctgggtgcgctcgcgtgttccagccagccgtccgcgtcgagggttttgactgcctcgacggtggccgtagcggccgtggccatggcatcgccgccatggtctagatgcacatacaacatcgaataaccaggaaatcttctcccctcagtagtgcaaaagctttgggagggagagagatgagagtgaagagatgaatgagaggagccttatgtccaaaattaaccccctaaaacttttttatccattaattaaattccattagtttt

SEQ ID NO: 6986 - DNA, 357 bp, Triticum aestivum
  Clone ID: LIB3281-046-P1-K1-E8
cccacgcgtccgcggacgcgtgggcccccacctaccaccactctcctcctccctcccccactccagtctcataaatcccggaccccacgcgaatctccccgcacccgcggcgaatccacgagggggagcgacccgccgctcgattatggagttcctgcaggggcagagcacggagaccacggtggccgtcgcggtcgccgtcgtcgccgtggccgccggcgccggattcctcctcctccgcagcaagaaacccaagggctgcttggatgctgagaatttcaaagagtttaaactcgtgcagaagagacagatcagtcataatgtggccaagttcaaatttgctctcccgacacctac

SEQ ID NO: 6987 - DNA, 375 bp, Triticum aestivum
  Clone ID: LIB3281-046-P1-K1-E9
gcattttggtctgttggagaaaagtgtagactcaagtattttatgtggtgctactgatatttttggtgaatatgcaaaaatatcaaaaaacctgtcagacaagccccaaagctcctacacagtggacactgatcaagacaatggactgctgccgtctgttatcccgattggtgcaccatggcaacagatacacctattagccaggaaacagaagaaagtatatattgaattgtttgagttgactcctgtcaagttaactttcagttttactagcactccatggctcaataggaatgaaggtgtctcagaccccagcacaagcttcaacaacagtactgcaattcagagaggccttatggctctcattgacgttga

SEQ ID NO: 6988 - DNA, 360 bp, Triticum aestivum
  Clone ID: LIB3281-046-P1-K1-F1
gtgctttaggaccaccgcggcgttctttcattgcaaaacatagaactactaatcttaatgtatttacatagcttgcctgctgtattgaccatcaccaatattgttcaggggtttaggttgtaaattatgctgttttttcttgagctgaaatagaaataacacattagggaattcaactcattcggtgcatgttgcttgttggtgtgtctatgtacacattcagatatttctatgggcagatccattgacgttaggtttgttgctagattttcttttttcaacctctactttccaccggtatgctacactcttctactcagtacagtaaggccaccttgtgactgcgtacttctctatttt

SEQ ID NO: 6989 - DNA, 333 bp, Triticum aestivum
  Clone ID: LIB3281-046-P1-K1-F11
cggacgcgtggggttatacatggtgagcgaccctgactgaggggctatggatacggcagctctcaacctacttgttcttgacatttatgggttgaatctcaatgacgtgattatagtcatcgtagcaccgtccttgctgcagttactaaatagagctcttgataggcctggactcatagactgacaagggcatgcgctcttcccggaccttgctggcctccgacagatgctctaggtttacatgcgaaacgtgagttcttccttggatgcggtggcgaggaccatccaacggggggcgccggggttttcaggggctgcccatgctaacctagt

SEQ ID NO: 6990 - DNA, 171 bp, Triticum aestivum
  Clone ID: LIB3281-046-P1-K1-F12
gaactcgatggtcgtaaatcgagtgtaatcatatgtttgataggttcagtctgcagtttgcgtcatgctaagtgtaggtcacagaaggtagtggattatccagttagtcaaatcaaaatcggatgaactgtacatgctccacttctccagttcagttttgcatggaagttg

SEQ ID NO: 6991 - DNA, 361 bp, Triticum aestivum
  Clone ID: LIB3281-046-P1-K1-F2
cggacgcgtggggcagcaacgcaccgtcccagacagaccccgagcccgagcccaaaagccaggaaggaaggaaggaagcacaaagactctccacccacctactcgaaaccaaaatcccctctccgactcccagaaatccagcgcggcgattctgatctgcatacagatcccctcgagctcgctcgctcgctcgcttgctccggccggtcgtcgtgatttggagtgcctggaacgttcatgggtgtggagtgagatcgagagcggggaccgtgaattcctacgagggtcgccattcggcttgcgcgtctgcatgaactgtttcgtcaatctgggactcaactccaactccaaccactacgtc

SEQ ID NO: 6992 - DNA, 373 bp, Triticum aestivum
  unsure (1)...(373): unsure at all n locations
  Clone ID: LIB3281-046-P1-K1-F3
cctcgttcatctttctcccagatccgatcaaggcaccgccgccacccccacccaccaccgccgacctctccaccatctcctccccgtcccccatcgcgccgccatccacctngtcgcctcccatctcctccctcccccaccttccccacccccacaacaagatcgccgacgtgacgacagcaatggcggcgggtaccgggcggaggacaactacgactacctcttcaaggtcgtcctcatcggcgactccgacatcggcaagtccaacctgctctcccgcttcacccggaacgagttcagcctcgagtccaagtccaccatcaggggggtcgagttcgccacccgctccctctaggtcgacggcaagggtcgt

SEQ ID NO: 6993 - DNA, 388 bp, Triticum aestivum
  Clone ID: LIB3281-046-P1-K1-F4
caaactcgttgcacaacaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcat

SEQ ID NO: 6994 - DNA, 379 bp, Triticum aestivum
  Clone ID: LIB3281-046-P1-K1-F5
cgcatgcatacgggaactcgttcttgtcaggcttgtgtactgcaaacatgtctgcttgccgtgcagcctaatcaatagtgaggtagtgcacaaaaactaaaaaaagggcggtcactctagagtatccaaccttaccttcccgcgcatgcgacgtgatagctattctatagagtcacctagataaaattacctgccgcgagctttacaacgtcttgactgagaaaaccatggctgtacccatcttaatctcgttggagaacactcctcttatctcagctgtcagtagtagacaagagggccggactcatcgtccttacgaacatgtgcacaacctgaatgacgaatgccacgcaccctgcagcgcagcattatgctcggc

SEQ ID NO: 6995 - DNA, 348 bp, Triticum aestivum
  Clone ID: LIB3281-046-P1-K1-F6
cggacgcgtgggcggacgcgtggggccaagtggaagaagaagcgcatgaggaggctgaagaggaagcgccgaaagatgaggcagcgatccaagtaggctgatgggggtggtgacggtgtgctgtagcttcctatgtgtgtctttggctgcggctgactgcgggcgtacttgcttggcatggtggcgccattcttctcatctgtcaactcgcttattccagaaacctgcactttagtaggcctgttatcgttgcttttagttgtaccaggagttttgctatcatgaccaatctatccaactgtatgaactctgttttggagctttatttgctgctaatattcggccccc

SEQ ID NO: 6996 - DNA, 378 bp, Triticum aestivum
  Clone ID: LIB3281-046-P1-K1-F7
cggacgcgtgggcgtctccaacctcggcgaaaccctagctagccccaccgaagccggagcaagccgagatgtctcgcaccggaccgatcgcccaggactgggagccggtggtcgtgcgcaagaagctgcccaacgccgccgccaagaaggacgagaaggccgtcaacgccgcccgccgcgccggcgtcgacatcgacatcgccaagaagcataatgctgggacaaacaaagctgctcatagcaccacatcgctcaatacaaagaggcttgatgatgatacagagaatcttgctcatgagcgtgtgccgtcagacctgaagaagagcattatgcaggctagaacggacaagaagctcacacaggcacagcttgcacagg

SEQ ID NO: 6997 - DNA, 375 bp, Triticum aestivum
  Clone ID: LIB3281-046-P1-K1-F8
gatgacgtgagtcagtcagctggtagagacgctatatacacccgtgatttctctgcgcccaccggtgaagataagatggacaagagcatcttgcctaaggtcatgcaagtcaagcatttcgggcggagtggcagaacaaagtggacacatcttgttaacgaggacactactgactgggatgcaccatgggctacaaacgggccgctgcgaacaaaatataatgcaaaaatggcgggcatgaatgcacctattgctaaaccaaagggaagtaagaagatgaaggattgggatacaaagcgagatgattaaatgtttgttttgttggctttgacccggtaccactctcctactaccatatgatcactagctgaaaat

SEQ ID NO: 6998 - DNA, 355 bp, Triticum aestivum
  Clone ID: LIB3281-046-P1-K1-F9
cggacgcgtgggtgaaattattctaacacgctacaaggaagcttttacggaactagcagttctttcaaagacagcaatatgctgtcgtgttacaccttcacagaaagcacagcttgtcaagcttctaaagtcatgtgactatcgaactttggcaattggcgatggtgggaatgatgtcaggatgatacagcaggctcacattggtgtagggattagtggtagagaaggtcttcaagcagcaagggctgctgactatagcatcggcaagttcaggttcttgaaaaggctcattcttgtccatggacgatactcatacaaccgtactgccttcctttcacagtattcgttctacaag

SEQ ID NO: 6999 - DNA, 170 bp, Triticum aestivum
  Clone ID: LIB3281-046-P1-K1-G1
caagttcacctcatcctaggcttcatcgtcgtcgttttaacgaatcgatgatgatgttctgtatgtagttggcagtacgatgttacaatatttgtaaggattgtgctgcctgtgtgtttgaagaaatagtgatgttgctgtttgcaaaaaaaaaaataacacattaagga

SEQ ID NO: 7000 - DNA, 393 bp, Triticum aestivum
  Clone ID: LIB3281-046-P1-K1-G10
acccacgcgcgtgcgggaaataatcagtttgaaacatcacatggtaaacacactcattacgagaaaaatgtaaacagagtactatactacaatgtctccacagagacttcagatcacgagggtagaacctgaattcattaatactccctccggtcgggaatactcgactttgaaatggatgattatgaatgatatacaaaatattgctcgcggatgccaggtgcttctcttctctgcgaccttcaatgagaaagtgaaggagtttgttacaaaggccattaaggacggaaaccaaatatttgtgaagaaggaagatcttactttggaaaaagtaaagcaatataaagtccgagtccctgatgaggcggccaaaatagaggttataagggacaa

SEQ ID NO: 7001 - DNA, 276 bp, Triticum aestivum
  Clone ID: LIB3281-046-P1-K1-G11
gacaaacctccggacgaacctcaccgacaaggtgaccgacgagatgatggccgaaaccatcctcgacggcgatgtccacatcaactaccagatgaactacaaggtgatgatggcgaaattagcacccagctgcgcgctgcgctgcatgctgagaatcgtgcattgaatattacattaagtttcaacttttattgcatctattatcagatcaacatcctacctagcttgctatcttaaagcagatcgtacaacgcatttgctgactcaattcctgct

SEQ ID NO: 7002 - DNA, 381 bp, Triticum aestivum
  Clone ID: LIB3281-046-P1-K1-G12
ggaaagaagcctgttatgtctcagcattttatcaataaagacaaagatggaactgccaacagccgctgtacttgtgttgcatgggttccagagcgtgaaggcatttttgttgtcagcaatgctgatgggaatctgtatgtgtatgacaaatccaaggatggaagtgctgactgggcatttccaactgtaagggatcaaaatcagctggtgatttcacatgcaaagtccaataagagcaatcctactgcaagatggcacatctgtcaaggtgcaatcaatgccatttcattttcgccggatggagcttacatggcaactgttgggcgagatggttatttaagagtatttgacttcgcgaaagaacaactaatatttggtggg

SEQ ID NO: 7003 - DNA, 354 bp, Triticum aestivum
  Clone ID: LIB3281-046-P1-K1-G2
cggacgcgtgggccgaccttcgtccacacaccttataccagccaccgaaaaagcctcggtcccagcaaccacagaccactcacgtgagttcgagcgaggtaagaatagatccgagcgagttcttgcgtcgccaaggtaaagttctttgaatcccaagccctctttccccctgcgttgttcagttccttgatcactcggtaggcaccgaggtctccaggacgtttaagatccaggggcttcacatccgtacgttttcctcctatattagtacgcatagtcggccggacatactttactactcccacgatgagcgctcctaaaacactgaagaggcaccaacgccatctttttttg

SEQ ID NO: 7004 - DNA, 383 bp, Triticum aestivum
  Clone ID: LIB3281-046-P1-K1-G3
ctcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctccagggcccagattgactctgttcttgatcttgcacggtgcaccattgtgtccgagctctccaacaaggacttcgactcctatgtgctatctgagtcgagcctgttcatctactctcagaagattgtgatcaagacctgtgggactaccatgctcct

SEQ ID NO: 7005 - DNA, 388 bp, Triticum aestivum
  Clone ID: LIB3281-046-P1-K1-G4
cccacgcgtccgggaaataatcagtttgaaacatcacaaggtaaacacactcattacgagaaaaatgtaaacagagtactatactacaatgtctccacagagacttcagatcacgagggtagaacctgaattcattaatactccctccgttcggaaatactcgtcattgaaatggatgtatctagatgtattttagttctagatacatccattttggtgacaagtaattccgaacggagggagtagatactaacgggtgcaattgtggttatggattattagccgtgtagtgctgatttgaattgcacattgtggttatgaacccgattaacacgctgaaagttgaaaatgtcatttatctcctctctaattaatagtataactcagc

SEQ ID NO: 7006 - DNA, 387 bp, Triticum aestivum
  Clone ID: LIB3281-046-P1-K1-G5
cggacgcgtgggctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctcttgaggctgcccgtattgcttgcaacaagtacatgaccaagcatgcaggaaaggatgccttccacctcagggtcagggttcacccgttccatgtgctccgtatcaacaagatgctttcgtgcgccggggctgatag

SEQ ID NO: 7007 - DNA, 391 bp, Triticum aestivum
  Clone ID: LIB3281-046-P1-K1-G6
acgcggacgcgtgggcccgccctcctcgcgttcctcgtgcagaaccccgaggcctcggcagccatggccaccggcggcgaccgcgcggcggaggagctcgtgtccgtcgagatgcccgcgcccgagggatggaccaagaagtttactccccagagcaggggaagatctgagattgtttttgtctcaccaactggagaggaaattaagaacaagaggcagctgaacagctatctgaaggcaaaccctggaggccccacttcatcggagtttgactggtcaactggtgataccccaaggcgttctgctcggattagcgagaaagtgaaggtatttgatagccctgagggtgaaaagataccaaagcgtagtaggaactcaagtggaagaaagg

SEQ ID NO: 7008 - DNA, 351 bp, Triticum aestivum
  Clone ID: LIB3281-046-P1-K1-G7
agtgagtctagtttggcatccatccatccatccatggcgtccatgctgtgctcctactccgtctccatgcccgccgccgccagggctccgctcctccggtccaactccctcgggttcgccacctcgcagctcgccggcctcagcctcggcctcacctccacggccgcggtctccctccccaccaagaacaccatcgtcgcgcgccggatctgccccttcttggagaagaagacgaaccgggccaacaaggtgtccttctccaaccacaagaccaagaagcagcagtttgtcaacctgcagtacaagaagctgtggtgggaggccggcaagcgctacgtcaagctcaggctc

SEQ ID NO: 7009 - DNA, 380 bp, Triticum aestivum
  Clone ID: LIB3281-046-P1-K1-G8
ctttcaggaaacatttccaaggtggcctgcgctgtggctgcagctctgtgcaagaaaaatatcaaggtgataataacaaacaagcaagactatcatttccttcagcccaaaataccagaagatgcagctgacaaccttttactgtcgaaaaccggcattgccaaggtgtggataatcggagaaggtgcagatgccaccgaacagctcagggcgccgaaaggaacacggttcatcccgtactcacagttcccaccaagaatggcacgcaaggacggctgcacatactcgacgactccggcgatgagcgtgcctaaaacactgcagaatgttcattcgtgcgagaattggctgccaaggtgggtgatgagcgcgtggcgcgt

SEQ ID NO: 7010 - DNA, 372 bp, Triticum aestivum
  Clone ID: LIB3281-046-P1-K1-G9
gaacctttctccttctgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgccttgccatcgtcaacaagccactggcctcgccgtcagcactcgctcgccagtcccacccggtgagctcgtgcattcaacccgagtacct

SEQ ID NO: 7011 - DNA, 182 bp, Triticum aestivum
  Clone ID: LIB3281-046-P1-K1-H1
caagaagcaccagatcaaagtggcgctcctcccgctggtcctcgcggtcctcatcgtgttctgcgccgcgcagaatccaccggtgcaatcgtcgccaacgcccaacgcgccttctgccgtgaaccagtctggtgctcccaacgcgcctccggcaggcaaccctgctacagctcccacgcgac

SEQ ID NO: 7012 - DNA, 171 bp, Triticum aestivum
  unsure (1)...(171): unsure at all n locations
  Clone ID: LIB3281-046-P1-K1-H10
cggacgcgtgggcacgaaggtctatcttcgnttttaccaaattnaataggggtcattggggtggcgtaggtataattgactgggcgccgtttaaatcttctactgagaacaatgtacagctcaaatctgaaagaggtcaaaagtcacgtgctgtttttgcaagagatgctt

SEQ ID NO: 7013 - DNA, 381 bp, Triticum aestivum
  Clone ID: LIB3281-046-P1-K1-H12
gtgagggactcagcaaaaccctaattttcaccccaattcgccccttccaaaccctaaccctaatacgctcgatgttgtaatcccgccgcgtttgccatggctctagaggggcccgcggagcgacgggacgagggccagcagggagggatggcgaacgggaatggcgtggctccgccgccgtcgcgcatggccggccggccgttgggggcggctgcgtactctgacaggcggctgcgcctcaatccgaacacggagcacaagccgcaggactacaccgacgtgcgcggcgagtacgcgccagccgtgtacagcgccctggagcggcacctcccgcctagcctcctcgatgccgaccgtgatgtcaagctacacttcatgcgg

SEQ ID NO: 7014 - DNA, 382 bp, Triticum aestivum
  Clone ID: LIB3281-046-P1-K1-H2
cccacgcgtccgcggacgcgtgggaagcatagctataaagcacatgtttatgtaattggatattcgattgatgacttggagggtattatccctaccacctgcattgtctcttttgttgagagttctttcaggtttttgcttgtgcacgatccactacaggctgacaaggttcgaggtgacattccttgggaccctggtggactcagagcatggtgacgaggagaagcaaggggcacacacaaagaagagtgaacctggagcatccatgaggaagcaaaggtgaagagctgcagttggtgagatgatcgagctagtgctacatcatttgaagagcccggcgagctgtttcatgacccattctgaatatcataaatacatgctg

SEQ ID NO: 7015 - DNA, 389 bp, Triticum aestivum
  Clone ID: LIB3281-046-P1-K1-H4
cggacgcgtgggcacgaaggtctatcttcgagaggaccaacttcactatcggttcataaggatggtgttggtataagttctgaggcgcagctaaaatcttctactgagaacaatgtacagctcaaatctgaaagaggtcaaaagtcacgtgctgtttttgcaagagatacttccagaggagcaacagctgagaagggatttcagcctgatacagatgcaggaacaagtgtggcaggtggaggccagaatggtcactcacttgttagtgggagtttgtcaagcatgtcagatccacgaggttacagcctcaatagcttatactctatgattcggttaagagagccaccgagcaccttgaaaccatcagaaaacaagactgaccgggacag

SEQ ID NO: 7016 - DNA, 294 bp, Triticum aestivum
  Clone ID: LIB3281-046-P1-K1-H6
aacgtgagggcctaatccaagtgatcctgtaaaaccagcaagccgctcgtaactgagacctctaactcatgatatctgctctgcagttcgaatacccatcgtcgttcagatgtgagatctcaccaaggcccgcaatgtctcagcatgtgggactcaaaggagggatctcaagcgagggatgagcaacagctacagtcagctctgttcatgtattaacctgaagatgaaccttcagtaatggcataacaccacgaacagtcacttcaagacatgtgtggacctaaagatgatcct

SEQ ID NO: 7017 - DNA, 329 bp, Triticum aestivum
  Clone ID: LIB3281-046-P1-K1-H7
cggacgcgtgggggccgctcgagaacgccgccgccgtcgtcgagggcggcgtcgccgccccggtggtgccggtggtgaccgcggcggcggcgggaggggggtcgtacgcgctgctgcagtgcggggaggactcggcgtacgtgcgggacgcgtacgggggctacttcgaggtgttccgcgcgctgctggccgaggacggcgagcgctggcaggtgtaccgcgccgtgcgcggcgagctgccttcggaggaggacgcggcggggctcgacgggttcgtcatctccggcagctgcagcgacgcccacggcgacgagccctggatcctcgcc

SEQ ID NO: 7018 - DNA, 378 bp, Triticum aestivum
  Clone ID: LIB3281-046-P1-K1-H8
cggacgcgtgggggcagcttttgacttatggtagcaggaagcctatcgatcattttcttcagtgcatggaggaactgaccctagatgacattacagcgtttgctaagatgttgttatcttcccaacctacaatggctagctatggagatgtcgataaagttccgccgtatgagtttgttagcaagcggttccaacggttccgatagcgccctaacaccaagtattagggtgaagacgaacacacagagctctgttccagttctccctaatacttggcgttgtgcccggaaattttctttgttttacttgtgcgtgaacgaggttagttttgtattggcttagttcaaacagcgcatgctgatgaaatgtctcgggtag

SEQ ID NO: 7019 - DNA, 381 bp, Triticum aestivum
  Clone ID: LIB3281-046-P1-K1-H9
cggacgcgtgggccaacgcgtcgcagatccagcagatcacggcgcacctggcccactacggccgcatcgagggcaagaacgtcttctactggttccagaaccacaaggcccgggaccgccagaagctccgccgcaggctctgcatgagccaccacctcctctcctgcgcccactactacgccgccgccaacgccggccagtaccaccaccagcagcagctcctcggcgccggcgcggttccccctccgctgctgcagcaccagcagcagcagcagtactactccgcctcctgcgccggcggcagctacgaccagcacctgctcccgacgaccgtcccagcttccgcttatgctgctgctgctgctgggtacgcctacccct

SEQ ID NO: 7020 - DNA, 394 bp, Triticum aestivum
  Clone ID: LIB3281-047-P1-K1-A1
cgtttcccctctctccgagctgcagcccgcctcgccgtcgttacctcccacgcaaaccctaaccctaggcaccgccgccgccatggccagcggcaacgtgtccaccgtctacatctccgtcatcgacgacgtggtcgccaaggttcgtgaggacttcattacctacggcgttggcgatgccgtcctcaacgagctccaggctctctgggaaatgaagatgctgcactgtggcgcaatctcagggaacatcgaccgcaacagggccccccccgcttccgctggaggcgctcctggggccggcgcgactccacccgtgcacgacctcaacgtgccctacgaggccacgtccgaggagtacgccaccccaaccgccgacatgctgttcccaccgacg

SEQ ID NO: 7021 - DNA, 381 bp, Triticum aestivum
  Clone ID: LIB3281-047-P1-K1-A10
cggacgcgtgggaaaagggatatgaaacacaggttggtcgagctggtttggcgttgactgatgaacagaagatcaaaatttctatcgctcgtgctgtgctttcgagtccatcaattctcttacttgacgaagttacggggggacttgattttgaagctgaaaaggctgtgcaaggagcattagatgttctcatgctgggaaggttgaccattataatagcttggcgccttagcctcattaaacatgctgtttacatagctgtaatggaggagggacatcttgttgaaatggggacacatgaagaattgctaaacttggatggcctttatgctgaccttttgagatgttgaggaagcaacaaaactttctaagaggatgcca

SEQ ID NO: 7022 - DNA, 380 bp, Triticum aestivum
  Clone ID: LIB3281-047-P1-K1-A11
gagagctcccaaggtcgcgccgcggctcccccctcccccaccgcatcccgccggtcgctcgactcgcctcaccgccgccgccggtcgacatggggttcgtgtccttcgccgggagggtcctcttcgcctccgtcttcctgctctccgcctaccaggagtttactgaatttggaactgatggcgggccagctgcaaagaatctgcagccaaagtttaacagtttcaccaaaaatatctccgtacacctcggagtggtggtgcctcatgtagagttgaagcatgtcattgccgctaccattggtctgaagggtctgggaggtctcctgtttatcgtcagcagttcatttggtgcttatctcctggccctctaccttgctttc

SEQ ID NO: 7023 - DNA, 396 bp, Triticum aestivum
  Clone ID: LIB3281-047-P1-K1-A2
cggacgcgtgggtgccagcgccgccgcgcaggcggagcacaggatctactgccacctctacggcgcgctcgtcgccgccgggccccccgccgactgcattctgcactgcatcggcgcctccagcaccgacaactttcccgacgagaccatggacaacacgctcgagccgcaggaccgcgtcaacaaccgtttcttctactggtccagcgccggccaggacgaccccgacgtgcccgagacgctcacctacaggctcgcctccgacatctgcgtcgtcgatgagatcaggatacagcccttcaaagcattctttcagattggacatcctatatactcttcaaagatggtgcgggtccggatgggccattgcaaactttctcgtgcatcagagtcatt

SEQ ID NO: 7024 - DNA, 187 bp, Triticum aestivum
  Clone ID: LIB3281-047-P1-K1-A3
cggacgcgtgcgctaccggtatgccctacatgcgaaggaaatagcgaagatatttcatgcatccgcgaggtgtgccggtgctattattcaagccaaccggcactgcaagctccgacctaacggttctccaacagacgcctagtgtccttacatgaaggagtaccccgccaagcttacagggcacact

SEQ ID NO: 7025 - DNA, 340 bp, Triticum aestivum
  Clone ID: LIB3281-047-P1-K1-A6
tttcctttttcttttttttctcttgctttttttttttggaaaccatctttctttttttttttttttcttttttttttgggaaaacttttgcaaggggtcccctctccaatgggccttaattcacccccgcccccattttttttttttccatggatcagggcttcgctttcccccactggggttctttttttccttttttcccaccttcaacccccttgtttttgggttgtgaaacgacaacaaaccccctccctataaaggggggggcccttagtttaccccctttcaccccctgaaaggggggggggtaattttttttttacttctccccaatttccct

SEQ ID NO: 7026 - DNA, 185 bp, Triticum aestivum
  Clone ID: LIB3281-047-P1-K1-A7
gaactaaagcgacaaattgaccatgatttgttgtgtgtaaatgctcatatcccattaaggtcatgtgtataaatcaagcgggctgaagtgtgctgtgaattttctaaaaaattttacttgagatattatatgcatggagcggattgttgagtctgcgggctcctttccgtgttcaagggaaaaac

SEQ ID NO: 7027 - DNA, 258 bp, Triticum aestivum
  Clone ID: LIB3281-047-P1-K1-B1
cccacgcgtccgcggacgcgtgggcgaacattcctctttctctcccttgcttggggaagaagaagaagaagaagaagaagagagggcgagcgcccccgcctcccgacgccgtcgcccctcgccgccgatctgatctcaggagccagcgaagatgcattccaccaatctgctcctcgaggagcccatccggatggtctccatcctcgagccatccaagccgaactttttcccggcgatgacgaagattgtggggacgct

SEQ ID NO: 7028 - DNA, 282 bp, Triticum aestivum
  Clone ID: LIB3281-047-P1-K1-B11
ctttagcaaaagatgctggtttcaaggtggttgcgcacatgatgcctgatttacctaatgtaggagttgagagagatatggaaagtttcagagaattttttgaaaatccagcattccgagcagatggtctaaagatctatccaactcttgtgattcgtggaactggtctttatgagctatggaaaactggaaggtatagaaactacccaccagagctggtagtggatattgtggcaaggattctgtcgatggtaccaccatggacacgagtctattgggttc

SEQ ID NO: 7029 - DNA, 340 bp, Triticum aestivum
  Clone ID: LIB3281-047-P1-K1-B2
gataggaacatatcatttattgcataataatcgactacacacgcatcttgcgatgatcgcaccattattcccttgtactaggcgatgtctatcgcaacgccattgttacaatatttagtgtgagcctttattttttgcatgtcttctcgcatcatatagtcgatcgactatgcgaacggcctttggttgtagcagtccaggttgtcaccgtagctgacgccaagaaggtcgcagtagcgcttgtagaacccgatccggtcggcgacacggccggtctgcccgcgcccgcactcgagcccaccgttgatgatgttggtgatcacaccgtacccaggcaccc

SEQ ID NO: 7030 - DNA, 137 bp, Triticum aestivum
  Clone ID: LIB3281-047-P1-K1-B3
gataggaacatatcatttattgcatggtaatcgactacacacgcatcttgcgatgatcgcaccatttattcccttggactaggcagagtctatcggaacgccataggtacaatattatagagtgagcccttattttt

SEQ ID NO: 7031 - DNA, 390 bp, Triticum aestivum
  Clone ID: LIB3281-047-P1-K1-B4
gtcggcgtacctgaccctgcaccccggcaggagcaggggcgactacgacgccgtcggctgcctgaaaacgtacaacgacttcgcgcagcgccacaacgccatggtccagcagaagctgcaggtgctccggctcaagtaccccgaggcccggatcatgtacgccgactactacggcgcggccatggccttcgccaagaaccccaagcagttcgggttcaagcaggggccgctgaagacgtgctgcggcggcggggggccgtacaacttcaaccccaaggcgagctgcggcgtgcggggatccagcgtgtgcgccgacccgtcggcgtacgccaactgggacggcgttcacctgacggaggccggctaccacgccatcggcgacaggattct

SEQ ID NO: 7032 - DNA, 386 bp, Triticum aestivum
  Clone ID: LIB3281-047-P1-K1-B6
cggacgcgtgggcggacgcgtgggtctttttttggagggagcaacaaactaacaactggtctaagtaggaaacagaagacgtcggtcggattagatcacagcaaaatggtccgcggttgcatgcagcaacgcggatgctaccctgcttgcttgcttgctaggtgagtgagctaatactaactagctatctagctagctaactcctagctggagacgaggcggcgtaaggctgcgacggcggcgccacggacaggctcaggtcgtcgctctcgagcgccagccttgccttcgtcgcagggggcgtggacggcagctcctcctcgggggaaggcggtctcttgctccctgcgccgaccggggcggcgctgaggtgcacgccgaagagc

SEQ ID NO: 7033 - DNA, 387 bp, Triticum aestivum
  Clone ID: LIB3281-047-P1-K1-B8
gtcactttgcagtgtggactaaataatgaacctaacatctgtttatcatgtcaccttgcaggtccagaacttgacagcggcccatgtcatgaaatgtgacgacgatacatttgtgagggtagatgtggttctcagacatatcaagatgaactcccttggcaaaccattatacatggggaaccttaacctcttgcatagaccactgagaactgggaaatgggcagttacggaggaggagtggcctgaagatatctatccgccttatgctaatggacccggttatgtaatttctggtggcatatcaaaattcgtcgtgtctcagcatgccaatcagagtttaaggctattcaagatggaggatgtaagtatggggctatgggttgaaaa

SEQ ID NO: 7034 - DNA, 173 bp, Triticum aestivum
  Clone ID: LIB3281-047-P1-K1-C1
tcgcacgtccgtcttaatctatatggttgtcggagatgccacccacgcgccggcggacgcggaggcgcagtctttgttggagtctttctgcgccttcaccttttcaaccccctacgaggcggacttctttctttagggtcacaactgggccctcgaggccgtcgttcgctcct

SEQ ID NO: 7035 - DNA, 382 bp, Triticum aestivum
  Clone ID: LIB3281-047-P1-K1-C10
cggacgcgtgggcgcggatctctcctcacctgccgcgaatccacgaggcggagcgacccgccgcccgattatggagttcctgcaggggcagagcacggagaccacggtggccgtcgcggtcgccgtcgtcgccgtggccgccggcgccggattccttctcctccgcagcaagaaacccaagggctgcttggatgctgagaatttcaaagagtttaaactcgtgcagaagagacagatcagtcataatgtggccaagttcaaatttgctctcccgacacctacttcagtgttgggccttccgattggccaacatataagctgcagagggcaggatgctactggcgaggaagtaatcaagccttatactccgactacactggat

SEQ ID NO: 7036 - DNA, 385 bp, Triticum aestivum
  Clone ID: LIB3281-047-P1-K1-C11
gcatgatgtggaagctggaaccctgaagaaagttgttcttgctgacggtgcggtggtaacagtgaaaggtgctagggcggtgagcctccgtttgcccctcgaactaccacttcctctcaaccgcaccacatacaagggccgtctgtctagcttgctttccattgctcgagccctacgcggtgcagctcggtctaatcagaaacccctgatgtccctccggatcgagggtccaacctccttatcctcaaccccgtccatgtctccgaatgacaagctcaagctcaaaaggttggccccaggtcaagtggagctcttctcgcgtgcgatccctgctgtcactgacgatgaggatgaatcgcctagccccggattgtggccctttttg

SEQ ID NO: 7037 - DNA, 382 bp, Triticum aestivum
  Clone ID: LIB3281-047-P1-K1-C12
gcagcttcggtgcagccgtcgacgccttggagccggagcaggcggcggcggaggcgaaggcttccttggccaacgccgaggaacatgccgcggcagcggaggcgttcgaggtggtgcagcagcagctgcatgtgaaggacgaggagaggctgagcccggggagcggcgggagcgcggtgctggacgcgagggacgcgctgctcgggagcggatgcggtctcgccggcgtggtggacagcagcgtggactcgtactgcttcccggggggcgccggcggcgacgagtaccacgagtgcgtgatgggccccgtggcgggcggcatccagtcggaggaggacgacggcgcgggcagcgacgagggctgcagctactaccccgacga

SEQ ID NO: 7038 - DNA, 392 bp, Triticum aestivum
  Clone ID: LIB3281-047-P1-K1-C2
cccatgcgtccgcccacgcgtccgcggacgcgtgggcaggtatgttgatgccgtcctgactattcccaagggaacactgttccccatgtgtggcatgaacctcgcctttgaccgtcagctcattggccctgcaatgtactttggcctcatgggtgatggccagcctattggtcgctacgatgatatgtgggctggatggtgcgtcaaggtcatctgcgaccacttgagccttggagtgaagactggcctgccatacctgtggcacagcaaggctagcaacccatttgtcaacttgaagaaagagtacaagggcatcttctggcaggaggacatcatccccttcttccagaacgccaccctctccaaggagtgtgacacagtccagaagtgct

SEQ ID NO: 7039 - DNA, 392 bp, Triticum aestivum
  Clone ID: LIB3281-047-P1-K1-C3
cccacgcgtccggcccccatccccgccgccgcctcctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctccc

SEQ ID NO: 7040 - DNA, 381 bp, Triticum aestivum
  Clone ID: LIB3281-047-P1-K1-C4
gcaatctttatagcaatcagaggatctaggaagcccaggcagaatcaagatcaactagtactaaactcttactaagagcctctctagcgtcaaccatccggcgagaatggtggcgtcgtcgggcgagctgagggcgctgttcgcgtcgctcgacagggacgcggacggccggatctcggcggcggagcttccggggtgcatgcgggcgacgctgggcgaagacgtgccggcggaggaggccgatgccctggtggcgtcagcggatgcggacggcgacgggctgctgtgcgaggccgagttcctcgagctggcgcagcatgcgtcctgtgcgggcgacgcgttggaggaggacgacgagctgaggatccgggcgctgaggga

SEQ ID NO: 7041 - DNA, 351 bp, Triticum aestivum
  Clone ID: LIB3281-047-P1-K1-C5
gtagggccaataccggttgaacactaaggtaccccgtttaggatgaaaggaggcaccgtctgtgtgggttccaaagacattaacgcttttatcacccacagctaacctagaccaccttccgattgctaagcctacatagacaaggccagcatgacacatcgcataaactacaccctggccagatggtgcttgtggctgacaatgcatgcccagcaatatgttacatgaaaacgcaggaggcactggtgcttaatcggacagggaagacagggcatttacatactcatacgaggctgctgtacacatatgtgcaggcaacagagaacatactgaggtggtaaccaaacgacc

SEQ ID NO: 7042 - DNA, 392 bp, Triticum aestivum
  Clone ID: LIB3281-047-P1-K1-C6
aaaggatattcctgtccttattgcttgccaaggtcccagtggccgtgtcacacgagctcaagttgctaataatagtagaagatgtggagtggctcaccctgcactggtacctgtgagaactgaacaaaaaccgacagcgaaagggaagatgaaacggggagctttggatgagaatacttgtgtaagtgctgtagctaaagctccgcaccctaaaaggagagcagtgctcaaggacgtgacaaacataagctgtgcaaactcatacagaaattgcactgctgtgactaagctacaatcgaggcctaccgaaaggggaggacgaaatcctagcaataacaagcaacgttcaaaggtccctaaaccacctttttctgctcttagtggaactacat

SEQ ID NO: 7043 - DNA, 250 bp, Triticum aestivum
  Clone ID: LIB3281-047-P1-K1-C7
gcgtacggccgccgcagccgagatggccgccggagatgccacccacgcgccgtcggccgcggaggcgcagtctctggtggagtcgttctgcgccgtcacctcggcgacccccgacgaggcggccttttttctcgagggccacaactgggccctcgaggccgccgttcgctccttctacgacaacacggaggtcgacgccgatggccccgatccggcaccccaggccccgccacccgttccaggcgctgtc

SEQ ID NO: 7044 - DNA, 327 bp, Triticum aestivum
  Clone ID: LIB3281-047-P1-K1-C8
cgactcccttcctcccctcctcggccccgactccgactccgactccgactccgaccacctccccccggccccgcgccgtggccgccctcttcggcctccaccggcgccgcgggtggaaccctcgcctccggcgcctcgcaggtgcgaggctacccccgccccggagggcaccggtggagcggcccagcagagttggccagggttaccaaggggtgtcgaatttaatcctagcgacagtgatcttctatggcatctggctgcagaaatggggaatggcctggctcatcgtcatccattcattagtgaatttattaaatctggggatga

SEQ ID NO: 7045 - DNA, 177 bp, Triticum aestivum
  Clone ID: LIB3281-047-P1-K1-C9
cacacacgccggccaccactagggttttaccgatccgcctcaccccacgccggccaccaccagatcccctgcgccctacgctcttaccgctgccgacgatggggggatacgggatccagcctatgctcaaggatgggcactagcatctatcgggcctcgacgagggcgtcctgtata

SEQ ID NO: 7046 - DNA, 129 bp, Triticum aestivum
  Clone ID: LIB3281-047-P1-K1-D10
gggacgcgtggggaatcaaccattcgtatgtctgaggctcatgcgaagaggcatctgcgaagctatgaatctcatgaagatggcgacaaagtcattcctgtgctgattgactcatgtcatatgaaccca

SEQ ID NO: 7047 - DNA, 338 bp, Triticum aestivum
  Clone ID: LIB3281-047-P1-K1-D12
cccacgcgtccgatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgctttcttaagaagggccgctacgcccagcgcgtcggctccggcgcccccgtctacctcggcggcgttcttgagtaccttgcaacccaagtgcttgagcttgcccggaaccccgcccaggacaacaagaaaaggcgcatcgtgcccaagcacct

SEQ ID NO: 7048 - DNA, 154 bp, Triticum aestivum
  Clone ID: LIB3281-047-P1-K1-D2
cttccgttttccggacattttttttccattcttcccaatcggcggcggcaaaacattggcggcggcttaccttggggggggggtcaaccccttcttctttttcggcgggggggggtggttccgggcaacctctttcttgtactgttccgcttga

SEQ ID NO: 7049 - DNA, 362 bp, Triticum aestivum
  Clone ID: LIB3281-047-P1-K1-D3
ctcagttcagttcactacccgcggtggccgcgagaacccggatcgcccatcgacagatggacgcggtcatatgcggcgcccacgaagcgccgcccgctgtcgtgctcgtttccgccggcgccagccactccgtcgcccttctggcgggcaatgtgctgtgcacgtggggcaggggagaggacgggcagctcgggcacggggacgcccaggaccggctcgtgccgacggtgatcagcggcttcgacgcgccggggatcacgtccgtggtggggggggcggaccacaccaccgtctacttcgaggacgtgcaccacgtctacagctgggggtggggggatttccgttggttcgtgctcctccac

SEQ ID NO: 7050 - DNA, 393 bp, Triticum aestivum
  Clone ID: LIB3281-047-P1-K1-D4
cccacgcgtccgcggacgcgtgggaaaaaaagaacacaccacaccacatcgcagtggtactacaacaccaggcggaagcccccccagcccttccccaattcattccattcgttccccattcccctcccccaatccccctcccgccgccgcgccgcgccgcgccccgacctcctctgtctcggcgcgggcatcgggatccgggggatctggtgcgggtctgagggatggaggccagcgccgggctggttgcgggctcgcacaaccgcaacgagctcgtcgtcatccgccgcgacggggagccaggggcgaggccgctcaagcagcagaaccgcggggcgtgccagatttgcggggacgacctcgggctcggccccggcggcgaccccttcgtcg

SEQ ID NO: 7051 - DNA, 98 bp, Triticum aestivum
  Clone ID: LIB3281-047-P1-K1-D5
cccacgcgtgcgcggacgcgtggtaaataaagaacacaccacaccacatgggagtggtactacaacggcagtgggaagcccctccatcctttaatcta

SEQ ID NO: 7052 - DNA, 387 bp, Triticum aestivum
  Clone ID: LIB3281-047-P1-K1-D7
gcagtctccagagatgacaccattagtatgggtcagttgcattggtgacgctgagcacaaagctatgaatccactcccttttgctctggactgtgtttggttatggcgtaaactggctatctcgacaacatttatgctgaagttatcgaccctccaaagaatgggatgttagatgtcatagaacttgtctgtggtgttatcaagcattcacggaatccaaatgtcatggtttctagaaatgggcgtgagctattggaatgccccatgtgtttggttcccatgtatcctccaattcatcagtgctccaatgtccatgctatttgttctgaatgcaagccaagggttcataaatgctttggagaaggttggcgcctctctagaggttct

SEQ ID NO: 7053 - DNA, 377 bp, Triticum aestivum
  Clone ID: LIB3281-047-P1-K1-D8
gagaaaagtagctgcacagcagaacctgagttagaaactaggcagaagagaagaagcttattcagttctgttggtccagatgttgaaaatgaacagcacatggaaatggatacttcaggaggaattaaagaggaagcaatgaatgatctgaatgcagcaaaagttgcagcaatgaaagctgctgaattagtgaataagaacattgtaggatttggagtcggaactgggcggctatccactgaccagaagaagaagctgctctggggtaacaaaaagagtaaccctccaaagacaagtacccactgggactcaaatctgttttctgatcgggagcgccaagagaaattcaacaaactcatgggtgtgaaaagcagtgc

SEQ ID NO: 7054 - DNA, 388 bp, Triticum aestivum
  Clone ID: LIB3281-047-P1-K1-D9
cggacgcgtggggaatcaatcattcgaatgtctgaggcacatgcaaagatgcatctgagaagctatgtgtctcaagaagatgttgacatggccattcgtgtgctgcttgactcattcatctcaacccaaaaatttggtgtccagaaggcacttcagaagaatttccggaaatacatgacttacaagaaggattacaatgaactgcttctgctccttctgcgcaccctggtcaaggaggcgctgcactttgaagaaatcgtgttgggatcaaccgcacgcctgactcatgtcgaggttaaagtggatgacctgaaaaacaaggcccaagagtacgagatctacgacctgaggccgttcttcttcagctctcacttcagcgacaacagct

SEQ ID NO: 7055 - DNA, 362 bp, Triticum aestivum
  unsure (1)...(362): unsure at all n locations
  Clone ID: LIB3281-047-P1-K1-E1
gccacgcgaacgctatctcaaggggtggtcgatcgcgagcggatggcattttgtagatgttctgatgagtgcacccgatgcctacacacgtggcagaacaaaggcttattcccggggctggaacatataaaatcctgacaattggattttgctgggggaggaccacaaggtcatagagcttgggccacacagtgcctcatctaccataagagcactacccatggttaggagagggtgcccgcctaaagatcttgttggtccaaagctctcctgcaacaataatacatggcggctgctgtcgntgatatggaggatatgataatggtactggatgctttcctagctgccgggccatatatggg

SEQ ID NO: 7056 - DNA, 330 bp, Triticum aestivum
  Clone ID: LIB3281-047-P1-K1-E10
cggacgcgtggggctagctcatccatcgagctacctcctaggtacgtacacggtacacactcactgcatgtcattcctcgtctagcttagcgcgagacatatatcggtcgccagggagagggatcgagatcgtgagctggtcgggctcgaagaggaggctaaggcgccatggacgtcaacgacgtgctgctgctggcgtcggcggtggtgctggggctggtgtggtggccgccctgtttcaaaacgggcggcgtggacgggatcccctcaggcccctccgggttgtcggcgttggggaaatcttttacaagtgttcctgcaaggacggcc

SEQ ID NO: 7057 - DNA, 228 bp, Triticum aestivum
  Clone ID: LIB3281-047-P1-K1-E11
cggacgcgtgggcacgcctcatccgtggcgagagggcctaagctgctctgcgcgcgtcgccgactgagccagatgtgttcagcgcttaaagtgttggtacgtgccatggtggatgtagagggcctgatatgatgtgatcatcttgctgtcatcagtagtttagatgaaattgtcgtctatctcgtgctactgctggcgttggtagttgtgctggggctggtgtggtgg

SEQ ID NO: 7058 - DNA, 380 bp, Triticum aestivum
  Clone ID: LIB3281-047-P1-K1-E12
cggacgcgtgggcctgtacacgcacagcaggaagagaggccaggtagctagctagcttggtagcttggtaaccatggcgaagaaggcggcggtgatcgccacgctgctggccctgaacctgctcttcttcaccttcgccgacgcctgcggctgccactgcggatcctgccctagtccgggcggcggcggcggcggtgggggtggcggtggaggtgggagcggtggcgggggtggtggagggagcggtggatgcagatcttgaggaggcggctgcggcggaggtgggtcaggagggggtggcagaggcggctgcgggtcccgctgtggcggatcgggaggaggcggatcaagcgggcgcgcccggtgccacattgacacgc

SEQ ID NO: 7059 - DNA, 393 bp, Triticum aestivum
  Clone ID: LIB3281-047-P1-K1-E2
cggacgcgtggggtcttgttcagcactatataaaattgacagagtcagagaagaatcgaaaattgaacgatctcttggatgctcttgatttcaaccaagttgtgatatttgtgaagagcgttagcagggctgcagagctgaacaagttgctgtgtgaatgcaacttcccttcaatctgcatccattctggcatgacccaggaagagaggctgacccgatacaagaacttcaaggaagggcacaagaggattcttgtggcgacggatttggttggcagaggaatcgacattgagcgtgtcaacattgtgataaactatgacatgcctgattcagctgatacctacttgcacagggttggaagggctgggcgttttggcaccaaggggctcgcca

SEQ ID NO: 7060 - DNA, 346 bp, Triticum aestivum
  Clone ID: LIB3281-047-P1-K1-E3
cccagcggtcgggcaagcgtgagaactacaaaaacttgctggccagtcaggacgagctggaggtgctactggaggtcatgcatcgccggcatggcacccacaagtgttctactaaatcagagcgagccgggccctctccctcgacaataggaccacggaatccatacaccacacactttgaatctatgcgggcctcagccactaatatacgggggtcctacgcactaacatggtcgatggagccccgacattgctcgccgccaccgctacctatgtcacaggctccgacggcttccccacccacagtgtgacgaacggatgcacgcgcggttcatgctatagctcc

SEQ ID NO: 7061 - DNA, 286 bp, Triticum aestivum
  Clone ID: LIB3281-047-P1-K1-E4
cgcaaacccactcgcaccgggccaattacacaaagagcgcccacgcacaaagattccggtgatccctttaggcagctatgctactctgactagagcagtggaggttcatatcgccaacggcgcgagcccagccatcgtcctggacctctggaccacctactgcctcatgcttacatggtacaatgaccgggcattgatcatctgcgaacaccaggggcaccgcaccacgcttttcgacctcggcttctacgatacctaaggccttattggccacacctattagaac

SEQ ID NO: 7062 - DNA, 382 bp, Triticum aestivum
  Clone ID: LIB3281-047-P1-K1-E5
ccacgatgccgtcgcacaagaccttccggatcaagcagaagctggccaagaagcagcgccagaaccgccccatcccctactggatccgcatgaggaccgacaacaccatcaggtacaacgccaagcgcaggcactggcgccgcaccaagctcggattctaatccggggatgacggcgatgacacccgttgctgccgacgggagaagggtctagggtacctagggtttatgatgtctcgttgtttttgcatgctagcaagtgactccgggatgccagttttaagatttcgcttgtgttgaaagatattattattattactgcttgtagcctacctgggataccgtcatattttgctgattatggaaccccttttatcctgctt

SEQ ID NO: 7063 - DNA, 247 bp, Triticum aestivum
  Clone ID: LIB3281-047-P1-K1-E6
acgcgtacgcggacgcataggacctctccatatcaagcaggagctggccaagatgtactggcagaaccgtcgcatgccctactgtatccacatgaggaccggcatcaccattcggtacagccgcgagcgcagccactgtcatcgaaccatgctccgattattaccccgtgattacggggatgactcacgttgctgccaacagaagaagggtctaggttacctacgctacattatgcgacgttggttt

SEQ ID NO: 7064 - DNA, 385 bp, Triticum aestivum
  Clone ID: LIB3281-047-P1-K1-E7
aatgaagtgaagagggcagagtatcttggtcttattaatcaatgcatcatattatgtgcgcaataagattttgctatgctttcaccgtcgatgcccactggttggatcatgcttctgtttatgagctcattgaagtaactctctcgtagctcaaatgggccaatttctcgtttgcgtggcacacaaaaccttcagctattcatctccatatcaggtggtctgtcttaaatctgtaatcttctggaaatatgcttaagtataataaatgatgcgaaagtcgatcataggacatgaacacatggtgtaaaagaggcactcatgcaccaaaactattaaaagcagccaagaaaatggagtaaagaggcacttgacttgtagattatac

SEQ ID NO: 7065 - DNA, 373 bp, Triticum aestivum
  Clone ID: LIB3281-047-P1-K1-E8
cgggcgcgtgggaacacgccttgtccacccatacctatacaaggcagatctaggcctgacctgtaggttcctgaccgtgctcgactggatctgggggtaagctgaattcggcgtccatgatttgttccgatcacccgtttgttatctgattcccagggttgaccttctgatcggcgaggtggggcttgcggcgatcttggagaaaagacgggaggcaagctggatctgcccacggaagcttccgatctgcccggctggcgtctcagaactgcggctgttgtgatgcttaaaggcagatctggtttttaccgggggcttaaagaccagagcaatggctggcggcgagttttacggctagcacgtgggattccct

SEQ ID NO: 7066 - DNA, 348 bp, Triticum aestivum
  unsure (1)...(348): unsure at all n locations
  Clone ID: LIB3281-047-P1-K1-E9
aaaccctcgccgtcacctccctcccctgcccctccaccggcggccatggagacggacccgcgagagatcatcggcgcctccgggagcgtctctaggagcgatttgcgcgccgaccttgagcgccgcggccaggaccccgagtcgctggatctcggcaccaacatgatgctccacatcctgtacggctacctcccgaagccgcccgtcttccccaccgccaccatctcgcccgccggcgcttccagggtccccgacggcgtcgaccgcatcagccgcctccccgatgtggtcctcctcgacatcatctcccgcctccccgccaaggacgccgcgcgcacggncggcctc

SEQ ID NO: 7067 - DNA, 221 bp, Triticum aestivum
  Clone ID: LIB3281-047-P1-K1-F10
tgaggagctgatcccagagtggctgagctttgtcaagggcattgttgactctgaggatcttgccctgaacatttctcgtgagacacttcagcagtacaagatcctcaaggtcatccgtgagaaccttgtgaagaagtgcatcgagctcttctttgagattgccgagaacctgggggactacaacatgttctatgaggcttttttcagtaacctcaagcttg

SEQ ID NO: 7068 - DNA, 89 bp, Triticum aestivum
  Clone ID: LIB3281-047-P1-K1-F11
tcgcatacgcatgccaagggagaggggaagttagaaaggcacctccggagccgcatcccccggggaatccgcccccgattctcccgccc

SEQ ID NO: 7069 - DNA, 78 bp, Triticum aestivum
  Clone ID: LIB3281-047-P1-K1-F12
cgtacgcgtgcgaagggagaggcgaggtaggaagggaccgcgagtgcctcagtcactggcgaatctcgcgcacgaatc

SEQ ID NO: 7070 - DNA, 396 bp, Triticum aestivum
  Clone ID: LIB3281-047-P1-K1-F2
cccacgcgtccgcccacgcgtccgctaccaagaacacctccaatcccacaccagtccggcacaaatctgatccgccccctccattcccacgaacccactccccggccccctggtcttggcacgagcgcgtcggcaccatcgccccggatcggagcaggggcggctccggcgctgatctccgctcagattcggatttagggtttttgggcgtggtcgcggtggtgggttcgctcggccggtttggaaatgtcggcggccagtggcgtgcgcagagagggcgacgagcgacatgctgatcggccccaactgggccgtcaacatcgagctctgcgacatgatcaacatggatcccggacaagcaaaggatgcgcttaagctcctaaagaagcgccttgg

SEQ ID NO: 7071 - DNA, 360 bp, Triticum aestivum
  Clone ID: LIB3281-047-P1-K1-F3
aagggaggcatgggtctgggcatgggcggcgccaagcgccaccggaaggtcctccgggacaacatccaggggatcaccaagccggcgatccgtcgtctggcgcgtcgtggcggcgtgaagcgcattttggggctcatttacgaggagacccgcggagtgctcaagatcttcctcgagaacgttattcgcgacgccgtggcctacaccgagcacgcccgccgcaagaccgccaccgccatggacgtggtgtacgcactctagcgccagggtcgcaccctatacggattcggaggctaggccaccaccaccagattagagtgtctggggctcgtggtcgttgatgtgattgcagcatctcgc

SEQ ID NO: 7072 - DNA, 255 bp, Triticum aestivum
  Clone ID: LIB3281-047-P1-K1-F4
cggacgcgtggggtgatccatgacgatagcgtcaccaccactcataccgctgtccatacttgcgcaataggatccgttaatactactatagatgacgacttgaccgtctgcgacttcggatgactactaccaccataactcgaaggaagcactgcgaggaaccttaaccaatgacgtctatggtagcatgcttttccggcctacacaggtgtagtactttgagccccgctaggaaggacctcgagttaagtaaag

SEQ ID NO: 7073 - DNA, 285 bp, Triticum aestivum
  Clone ID: LIB3281-047-P1-K1-F5
ctatcgcgcaggcgccagggaaagagagagaaaaaaaacaaccagttcgtcggtagggtttcgggggctgcgatggcgatggaggctcggatgaaggggacggtcaagtggttcaacgacaccaaggggttcggcttcatcacccccgccgacggcagcgaggacctcttcgtgcaccagtcctccatcaaggccgacggcttccgctcgctggccgagggcgaggtggtcgagttcgccgtctcggagggcgacgacggccgcaccaaggccgtcgacgtcacc

SEQ ID NO: 7074 - DNA, 289 bp, Triticum aestivum
  Clone ID: LIB3281-047-P1-K1-F6
atctgaggatggaacttgcaaagtcatattgacccaaaggcccttgatccatctttaccgaagcaggatcccccataatgattgtactagtaaagcctacttcatggccattacttccagcaggttttcttgcaggcttactcttgcatgcccttgatgatgctctagttgatttctttttcttcttgtcatttctctcttccaaaactacattctctagttgcttcgtaatggaattagttatgcaaggcaataacatatccgtatcttcatccagttggaaaatctt

SEQ ID NO: 7075 - DNA, 378 bp, Triticum aestivum
  Clone ID: LIB3281-047-P1-K1-F7
ccgacgcgtagcggactcacttgctgaatctgttttttttttttaaccagagtaacaaacccttgaggagttcgtcgacggatctagacttttaggaaccctgtacggaacccagtggcaaactgactaaaacagggatgtacctgctaacgaactcaaggaccgacccaagtctggaaaatggtttcacgccttagggcaacacgctgggtgccattgttgtgcctgtgggtgcaccttcatcattggggttattatcctttggaatggggcttgcaccctcggtgttgccatttggaatagggttaaaagtgatgcctccatgggctgggctagcgcttgggcccctgccagtgttggaactttggcttggattgg

SEQ ID NO: 7076 - DNA, 375 bp, Triticum aestivum
  Clone ID: LIB3281-047-P1-K1-F8
cggacgcgtgggctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcggcgtcaacgaccccttcatcaccaccgagtacatgacctacctgttcaagtacgacaccgtccacgggcactggaagcacattgacctcaagctcaaggaccacaagactctgctctttggcgagaagccagttaccgccttccgcgtcaggaacactgaggagatcccgtggggtgaggctggtgccgattaccctgtggagtgcaccggtgtgttcactga

SEQ ID NO: 7077 - DNA, 258 bp, Triticum aestivum
  Clone ID: LIB3281-047-P1-K1-G1
ttatgtatattgttttagtggcctctgttctggttaaacggctgaggtatctccttttcttgactgtcttgaggcgtaatatctgccttggtacttctgcttaatttactatctgtgtcttagccgcagtcatgatctcatggataatgcatcccttgttggttttggctgatcaatatattgcctcgtgaataatcgaaccagcgttgctgcttgttatgtcgagggattttctaagaatgatgtcaaatgacctgc

SEQ ID NO: 7078 - DNA, 246 bp, Triticum aestivum
  Clone ID: LIB3281-047-P1-K1-G10
cgttgcacaagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctaacagta

SEQ ID NO: 7079 - DNA, 85 bp, Triticum aestivum
  Clone ID: LIB3281-047-P1-K1-G11
cgtacacatcgcgagccaaccccctgtaatgattaaccgtggttaccaccttggacaatataccggaaatgctgttggccttatt

SEQ ID NO: 7080 - DNA, 345 bp, Triticum aestivum
  Clone ID: LIB3281-047-P1-K1-G12
cccacgcgtccggctgtttgcatccgtgagcaactttatgagattgctagtcagactgtttctgctatgagagaagctaaaatgtcaaagaaaaggcgagcaccagaatttgcttctaatagtaaagccatgaacaacgcagtggacatgttcaagtattttgggagcaaaggaagtgtcattcggaaaaggaaggagtggtacctgtacgagcctgttgtagatgtcgtgcctaaagaggaagctgcggttgtggatgcaaaggagcagcttaaataaactctaagtgttggtgcgaaccctgaaggctgaagcgagggccaagattgccgggcagccgtgaag

SEQ ID NO: 7081 - DNA, 376 bp, Triticum aestivum
  Clone ID: LIB3281-047-P1-K1-G2
tcaatggagctgcaacaaccaacttctacgaaagatatgacgttgcgttggatgtgaatgtgatgggggtgaagtacctgtgccagttcgccaagaagtgtgccaatctcaagatgctcctccatgtttccaccgcatttgcagccggcgacagggaagggctgatcatggagaggccgttcaagaagggggagaccctgagggaaggcacctacctggacatcgacgccgagctgcggctgggcggcgacgtgaagaatgagctagagcggcaggacggcggcgacatgacgaagagggagcggaaaggcatgaaggagctggggctggagcgctcccgccacttcgggtggtccaacacgtacgtgttcaccaa

SEQ ID NO: 7082 - DNA, 118 bp, Triticum aestivum
  Clone ID: LIB3281-047-P1-K1-G3
ccaaccccaccgaatccacctctcgccggagtcccagcaaggagcgagcaagccaggaagatggacgccagcaagctgaagaaggtggccgggaagaagttcggcgggccgaggaaga

SEQ ID NO: 7083 - DNA, 388 bp, Triticum aestivum
  Clone ID: LIB3281-047-P1-K1-G4
ctctcctcctcctcctccccgttgctcgccgccgtccctctccgcctccgcgcacccaggaaagatggcgtcccacattgtcggatacccgcgcatgggccccaagagggagctcaagtttgccctggagtctttctgggatggcaagagcagcgccgaggatttggagaaggttgccaccgacctcagggccagcatctggaagcagatggctgatgctgggatcaagtacatccccagcaacaccttctcctactatgatcaggttcttgacaccaccgccatgctcggtgccggcccagacctgtactcatggaccggtggggagatcaatttgagcccctacttttcgatggctaggggtaacgccaccgtccctgctttggag

SEQ ID NO: 7084 - DNA, 381 bp, Triticum aestivum
  Clone ID: LIB3281-047-P1-K1-G5
cccacgcgtccgcccacgcgtccgcccacgcgtccgggagcgccgccactgccccccgccgccggctggccctccccgccgcccgcttccccgccgcccacttccccgcctccataccccgccctcacccgcagtcccgcttctctcgtcccctcgtggccgcaccaccccatcggcacggtcccgccaccccgccccacccacccaccgacccaatgttaaaccctagacttctccccctcaaaccctaggaaaggacacatgtattgtcggagccgccccgcctgagcgcggaggaagcggagccccggagcccctctgcggaggagaagaggtccaggaggccccgcgtggctagaagggagcgggcaaaatgaggat

SEQ ID NO: 7085 - DNA, 153 bp, Triticum aestivum
  Clone ID: LIB3281-047-P1-K1-H1
gcgattgcaatgggcacactaatggcgatctgagaatcataccacctatactcgatgccgggatgcgtgacggccaaccccagggtgatcatccacatcaccgtacagtggcgcgccggccgggcgcctcatgaagaaactgtacaaggacgc

SEQ ID NO: 7086 - DNA, 288 bp, Triticum aestivum
  Clone ID: LIB3281-047-P1-K1-H10
gggcctcttggccgccgccaacgcagaactcagatctcgctcttgcctccttgcgcaaccgtcgtcgagaggagcaagaaaatggcggcgagcaacctcgagggtgtgctcctggggatgggcaaccccataattgacatattggccgtcgtagacgaggccttcctcgctaagagtgaggtcaagccgaacaatgccattctcggcgaagacaagcacttgcccatgtacgaagagttgtccaggaaggaaaatgttgtatacattgttggaggagccacccataac

SEQ ID NO: 7087 - DNA, 295 bp, Triticum aestivum
  Clone ID: LIB3281-047-P1-K1-H12
cgccgatcccaatggccacccaccaccggcccctccacgccctcctcggcggcggcgcagtcgccgacctgctgctctggaggcggaggaacgcctccgcggcggccgtggccggcgcctcggtcgtctggttcctcttcgagcgcgccgggtacagcctcgcgtcggtcctttccaacgccctcctccttctagtagttatcctcttattatgggccaagtccgccttgctgctaaacagacctcttccaccagtgcctaatctagaggtctcagatgtggttgtggagaaagc

SEQ ID NO: 7088 - DNA, 87 bp, Triticum aestivum
  Clone ID: LIB3281-047-P1-K1-H2
aagcgcctccgccccttccggcccaaacgcgttagccatggcgacaaaagcggccggcgacgaccccgccgacgccgccgatccccc

SEQ ID NO: 7089 - DNA, 297 bp, Triticum aestivum
  Clone ID: LIB3281-047-P1-K1-H3
gccctgctggcggtgcctcaccgggagtggaatgcctggggcgggaaatccggctggagctggtccacctcctcgtcttgatcatgttgctgtgagtttgccagggggaagagtgttgatatttggtggatcagtggcaggcctccactcggcgtaacagctgtatctcttggatccgactgaagagaaacctacgtggaggatactcaatgttcccaggcaacctccacgggttgcgtggggccacagtacctgtgtcgttggaggacaaaagcgatagtgcttggaggacaaact

SEQ ID NO: 7090 - DNA, 201 bp, Triticum aestivum
  Clone ID: LIB3281-047-P1-K1-H4
aaccgcccggaagcccgggagacccacgcgtccggaggctggaccaccgcaaacctgggctcgcagctgcggcggcggcaccgaggggcccgggaactgctgctaccgagggtagtaggccggacatatataatatgaaggccgatctctgtccgattagaattaagcaacaagataataaaatgacccaatgagcgctct

SEQ ID NO: 7091 - DNA, 334 bp, Triticum aestivum
  Clone ID: LIB3281-047-P1-K1-H5
cggacgcgtgggcgccgctgccgccgccgcctctccctcgcactcgtcgccagcgcctctccgtcgcccgtgttgccggcgcctctccgtcgcccgcgtcgttctgcctctccctcacgcgtcgtcgccgccactccattggccctctcgtcctcaccccttcaggaccccatttttactttccgataggtggatccgaagcgcggcggctcgaccggcaacggcggcagctgcggattcattgctcctgcgtgcaccgtgcgctccgcggcctcatgttcagcagcagcaacaaggccagcaacggcgggagggaggggcagggcaacttcat

SEQ ID NO: 7092 - DNA, 178 bp, Triticum aestivum
  Clone ID: LIB3281-047-P1-K1-H6
cccacgcgtccgcccacgcgtccgaaacattttaagggtaggaccaaccagaagagcaaggatgtcaccacacttgactggaatggggaaggaacactattagccacgggctcctatgatggccaagcaagaatatggagtagggacggagagttaaagcacactttattcaaacaca

SEQ ID NO: 7093 - DNA, 121 bp, Triticum aestivum
  Clone ID: LIB3281-047-P1-K1-H7
cggacgcgtgggcagcggccaatctataagattacctcatacgtacactggcatgcgacccgttagcttttccatcgcggcacctatcctcagtcaagtagcggcggcgtcacaagcgcgt

SEQ ID NO: 7094 - DNA, 59 bp, Triticum aestivum
  Clone ID: LIB3281-047-P1-K1-H8
cggacgcgtgggcgccgaccgctcgcgaagcccacctctttggtgcaatggccggagac

SEQ ID NO: 7095 - DNA, 194 bp, Triticum aestivum
  Clone ID: LIB3281-047-P1-K1-H9
cgtgggcggacgcgtgggaagagagccagtagcagggagtgtagtgagagtagagtgagcgagaatgggtggcaaagccgctctcctggaggccctcctggcctggagcctggtcctttaggaccatggcgggcagcggctacggcggcgggcacgccctcacccagacaacggacgactcaccccccaagcac

SEQ ID NO: 7096 - DNA, 103 bp, Triticum aestivum
  unsure (1)...(103): unsure at all n locations
  Clone ID: LIB3281-048-P1-K1-A1
ccgatncgtttgttatctttttttcttactctttattaatcatttttgtggcggggttttttatggtgaattattatactctactttcatctatcccagcacc

SEQ ID NO: 7097 - DNA, 383 bp, Triticum aestivum
  Clone ID: LIB3281-048-P1-K1-A10
ggaggaggggagaagaagaccttcggccagctgcgggaagccgccgggggcgtcctccgcggcatccaccggcgccggtggcgggcagaagcgcaagtgccatgaccacgcgcactccgagaacgtcgccggcagaaagtacggcgcctccggtggccgctgccactgctccatccctcctcatcgcgccgccaccatcccttctccttcggcctcgcctcttcctcccttccctaacctagggtttggtgggtgagcttagtgtcgtctgccaatggtggacaaggagaaccggcatgaaccacgcacagggaggagctcgacctctacttgctatgcatgcccccaggtgagctgattttcttattttaataagctttttt

SEQ ID NO: 7098 - DNA, 181 bp, Triticum aestivum
  Clone ID: LIB3281-048-P1-K1-A11
cccacgcgtccgcggacgcgtgggttcaaccgcgacccaacccacccgggcattctcaccaccggcgcctcccccctcctcagatccgcgcgcgcccgcgcgcgaccagtcgctatgactgccaatggcggcgcgtcttcatcgcctgtcgtcacggtgtctgctgtcatctgtctctttt

SEQ ID NO: 7099 - DNA, 51 bp, Triticum aestivum
  Clone ID: LIB3281-048-P1-K1-A2
tacatctatattttactcataacaaacacattttttttatatttatttatg

SEQ ID NO: 7100 - DNA, 327 bp, Triticum aestivum
  Clone ID: LIB3281-048-P1-K1-A3
ccacgcgaccgcgccccccgccgccgccatcccttccttatagagacagcgtgtaggcgccgtgggagcttgtcaacaccggagccctatccatccagcccgtctaacgcctccgtttggagaggactagctattgctgctcgagagagagagatgtcgtttttactgtacatggcctactcgcccttcccgttcaccacacctcactcccatcgcattttcggcctacgcgccttctccgccgactttgccttcctggagaagtaccttgcggagttgctcgcggagcgccataagctgaactccttcgtcccagtgcttccttat

SEQ ID NO: 7101 - DNA, 291 bp, Triticum aestivum
  Clone ID: LIB3281-048-P1-K1-A5
agtgccagtgaggagaacttctttgccagctttgctcttggttggttgatgaccaacggtgcaggtcttgcatcttaccccattgacaccgtccgcagaaggatgatgatgacctctggagaggctgtcaagtacaagagctccttggatgctttccagcagatcctggcgaaggagggtgccaagtccctcttcaagggtgctggtgccaacatcctccgagccattgctggtgctggtgtgctctccggctatgatcagctccagatcctcttcttcggcaagaagtac

SEQ ID NO: 7102 - DNA, 372 bp, Triticum aestivum
  Clone ID: LIB3281-048-P1-K1-A6
cgctttcccaatccccctgccctctgtcaccgccctcccaatccctctgccctctgtcgccgccctctccctctcgtcgtcgccgcactcccactctcctcgtcgtcgcgctctcactcttctcgtcgccgcccactccctctccccgtcgccggacgagatgggctgctttggatgcttcgccccagcggcgcgccgaggggccggcgacctcaagccctgcaagctcacccaccactgcaccgacgacgactcatgtcatcttcttgactgatttctgcccgtcccctccccgccttgctgctggctggcgcaaagcactcttctttggtttgattctttcctaatccgggtggggtggtggggcttgga

SEQ ID NO: 7103 - DNA, 181 bp, Triticum aestivum
  Clone ID: LIB3281-048-P1-K1-A7
cttttttttttttttttttttttttttttttttttttttttttttttggggggttttttttcttttaatttcttttattttttatttaaaaaaaccaaaataaatccccacccataaaaaaaataaaaggaaaaaaaggggccagaaaacaaaccccaaaatttaagcaaaataccctgcc

SEQ ID NO: 7104 - DNA, 419 bp, Triticum aestivum
  Clone ID: LIB3281-048-P1-K1-A8
ccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatga

SEQ ID NO: 7105 - DNA, 398 bp, Triticum aestivum
  Clone ID: LIB3281-048-P1-K1-B1
cggacgcgtgggtctcctcctcctgccaccgatcccgaaccagggaggaaccgggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaagacaagatcaggcccctgtggaggcactacttccagaaca

SEQ ID NO: 7106 - DNA, 302 bp, Triticum aestivum
  Clone ID: LIB3281-048-P1-K1-B10
gagcgacagaaagagagcacatgatgctctgggaaatatttgcagagtactgctctccacaggagagaaacagataacaacaataaacaagagtgagtacaccaggcagttcgatcacatggatttttattaagaccagcaaccacaactattgcgaagctaggcgaccaatgactgactgagatgacgacgatgaagacctcggcacttactagggcataaccttttgaatcatcgtctcacggaattacgaggcagcccttcccaacagctgaagggccaaccgggacaggtgcataaat

SEQ ID NO: 7107 - DNA, 395 bp, Triticum aestivum
  Clone ID: LIB3281-048-P1-K1-B11
gcgggaaggagacgagagagaaaccccacagaccgctccaaaccccggcacgcccctcccccacaactccgccgccgccggtcgccatggagaggaagcaggccgactacagcaacctggacgagaggtacaccatccagggggagaggtaccagggccagcagtacagccacatctactacacccgcctccaccacatgcgcaccctcctccacgccctcgtcccctcccggaagccgcacctccccgtcactacagtgcttggactcgaagaaggaaaagattgtgtgcttgttgggactttatacaagcacatgaaacctgagccttctattctcgaagaatactcaaaggagaggtcggcaattcctcttgttaagccacacaatttcatg

SEQ ID NO: 7108 - DNA, 397 bp, Triticum aestivum
  Clone ID: LIB3281-048-P1-K1-B12
gaaccaagaagaagcagagcagctcagaaccgagcgcagagcgaagcggagccaaacgaaagaagggacctaacctaacctagccaagccagccggcgatcgaccgagagatggcgcggtggtgtcagctggcggcggtgctgctcgccgtgtcgatggcggcgtcgacgtcggtggcgcaggacgcgctgcagaccaagtgccagggggacctgcagaagctgtcggactgcatggactacgcgacggggcacgaggacacgccgtcggccaagtgctgcgaggacacggcggacacgcagaaagcgcgggccgagtgcctctgctccatcatccagcaagtgcacagcggcagccacggcgtgcagcagctcggccttcggttcgaccggcttct

SEQ ID NO: 7109 - DNA, 408 bp, Triticum aestivum
  Clone ID: LIB3281-048-P1-K1-B3
cgccccccgccgccgccatcccttccttatagagacagcgtgtaggcgccgggcgagcaggccaccaccgcaaccctagccagccagcccgactaacgccgccggttggagaggactagctattgctgctcgagagagagagatgtcgtcgggacggtacatggcctactcgccctccccgtccaccacgccgcactccccgcgcatctccggcctccgcgcctcctccgccgccgtcgccgaccaggagaagtaccttgcggagctgctcgcggagcgccacaagctgaacccgttcgtcccagtgctccctcatagcatacggttgctgaatcaagaaattttacgtgtttccacactattggagaacgcctcccttttaaaccaaagtggctttgaacatggtag

SEQ ID NO: 7110 - DNA, 314 bp, Triticum aestivum
  Clone ID: LIB3281-048-P1-K1-B4
agtacctgacagctgaggtcctggagctggctggcaacgccagcaaggatctcaaggtgaagcgtatcacccctcgtcacctccagctggccatccgtggagacgaggagcttgacaccctcatcaagggcaccattgctggtggaggtgtgatcccgcacatccacaagtccctgatcaacaagtcctccaaagagtgaacagaaaaaatagcaaaggagcatctctagcttaaactggacattttctcagtcgtctgtgagataagtttatcgtcgtgtcgtttagcgtttagctgtgctccttccagatcg

SEQ ID NO: 7111 - DNA, 364 bp, Triticum aestivum
  Clone ID: LIB3281-048-P1-K1-B5
cggacgcgtgggcggacgcgtgggcggacgcgtggggcgcccatgtccatgcaacaacaacagcaacaaccggcgcttgccaaccttctcggcgcaatgcctgcggcctccatgatcagcctcgccttcacggccgccgtggctaccgcggccttattcgtggccgtcgctgtggcgaggtacaaccgcaagtaccgggggctgaggctcccacccggcccgcccgggtggcccatcgtcgggaacctcttccaggtcgccttctccgggaagctcttcatccactacatccgcgacctccggcgtgagtacgggcccatcctgacgctgcggatgggggtgcgcacgctcgtcgtcatcagca

SEQ ID NO: 7112 - DNA, 303 bp, Triticum aestivum
  Clone ID: LIB3281-048-P1-K1-B6
tgagagcttcgacatcttcaagcagatggagcgcagcgcctaaggaatcggagagcatggtgggattaattagtactgctaccgcatgcatcggtcacttatcagctagctcatcatcatcatccgtcgctatgcatatatataatgcataagcgcacgcgttttatttgtgtttggttacttcgttgctgctgctgctgtgtcgttaagttgatggtgttgtctgttatatttgttgttggagcgtacgtactcacactttaattatgaacagctgctaccttataatatttttcatccgaa

SEQ ID NO: 7113 - DNA, 391 bp, Triticum aestivum
  Clone ID: LIB3281-048-P1-K1-B7
tctcggtccgcctgctcgatcgagtccagaccaactgccccgcccgccacccgcgtagcccagccgctccggtagggtttgcccgcccttccgtggccggcggcggccgtcagcccgtgctccgtccggaagcaatgtctacaccaactgggaatttcgtacgtccttatcatccggatgtgattgggaatgcgtttgctcaacaatactacagagttttgggttcgtcaccagagcatgtccataagttctatcatgatgaaagtatgcttggtcgaccagattctgatggtccattgacatctataaccactacatatgctatcaatcaacacttcttatctacagatatgaagggctgtttgatacagttagataatgtagatactca

SEQ ID NO: 7114 - DNA, 401 bp, Triticum aestivum
  Clone ID: LIB3281-048-P1-K1-B8
cccacgcgtccgcggacgcgtgggcgagcattgaagatcttgcagagaagttccctgataagattgttaaggttcctgttgatgtattcaagggaatcactgatgaggatgcagctaaagttgttgatggtctggcaccaaagacagcagacaggcaatcttctatagaacagattaagaagctatatgaacttttctgcaagaccgactgcacaatgctggagataaatcctcttgccgagacagctgataaaaagctagttgctgctgatgcaaagttgaacttcgatgataatgctgcgtttaggcagaaagaaatatttgcactgcgtgatacaacacaggaggaccccagagaggtggctgctgctaaagcagatttgaactacatcgggcttgat

SEQ ID NO: 7115 - DNA, 393 bp, Triticum aestivum
  Clone ID: LIB3281-048-P1-K1-C1
gttctttatcttgatcatacacatttacatgtatgattagtgtacggtcaaatcggggcgtcgcgtctccgaggcacaggtcgatttttttttttcggtcttgatccttatcgatctcgtcttctgctgtctttcccatctggtatgtcgcccgcctgctctatcccttccagagtccggactccctggttttgcaagattggccgctgctgggctgctacctggctggatcggtcccctgctggctcgcttctcccagatcgccactgacgcccctgctgccgcgcgcatcgcttgcctgctgtcccgccgctaggactccggttgaaggctgcgcctgcgtcttcgccgcttctgcctgcccgtcgcctcttctgcgcaacacaccttggc

SEQ ID NO: 7116 - DNA, 397 bp, Triticum aestivum
  Clone ID: LIB3281-048-P1-K1-C10
cggacgcgtgggcggacgcgtgggcaaacactaaaaccggagattatgagcaaaagccgagcggagcgttggaaaataacaggtgtcattgctttatctggttccagcttgaaggctgtgcctgaggaagtctgggactgtggctcctccatacgagtactagatgtctgtaacaactcaattgaagcaattccacagaaaattgctgcagttaaatcattaaataaattgttgctaaccgccaatgacatatctgatgggggcatcagctgggaaggtctatcatgtgttgatacattaacagttttatctttaagccaaaatcgattggtcactttacctccgagtttgggcacattgacttttctacgtgaacttcgcattgcaaataacatgc

SEQ ID NO: 7117 - DNA, 341 bp, Triticum aestivum
  Clone ID: LIB3281-048-P1-K1-C11
cccacttccgcaaaggagatcgataaggccgagaggaggaggaagaagctccagagttcaggcgaggagagggatcgcgttgcgcgtcggcgtggcgatggatcgggtccgcggctccgcgctgctgctcggcgtcctgctcgcaggatcgctgtttgcgctttgtgctgcaaaggaggaggccaagaagctcggtaccgtgatcggtatcgatctcggtaccacctactcatgtgttggtgtgtacaagaacggtcatgtcgagattatcgccaatgaccagggtaaccgtatcacgccctcatgggttgggttcaccgatggggagaggctcatcggtg

SEQ ID NO: 7118 - DNA, 284 bp, Triticum aestivum
  Clone ID: LIB3281-048-P1-K1-C12
actgtatgtggtaatgtcgtatcacttcaggtcattcatccattaatcgatcagatgagagatcaccgcaacgaaatgatgcttgcgattacaaggatgctaaggcagtagcgaagaaatgagatacgtatgagacatgatcgctgctgttacaacaaggaacgcctcggtgtgcctgcctgcctgccactgagcagagctgaagctaacagagcagagcaatctatccggtggccattgtcatcgccatcgccatcgcgcacgaaggaaggtcacatgattag

SEQ ID NO: 7119 - DNA, 397 bp, Triticum aestivum
  Clone ID: LIB3281-048-P1-K1-C2
catcaagggatgaagcggtggtatcgcaatgtatagaattgaatgaggagctggagaaggttcttgtacggcacgatacactactttcagttcacccaactacgacgacagtgccatctaatctcaaggaggacgaggaggaagaagatgctgaaagtctataccggagactgcggaaggggaaggctttatcgcaagaccacatagacgagtccgtgccatcgtttcgatctatacccgaggagaagatgcgccgcgcgctcaccattcagccgcctctccctgacaggaaacccactgcactgaacatccgctcaccagaccacccggaggcgaggcctgaccctgctgtcttgattccaccgccacccgccaagcacgctgagagggagaggtt

SEQ ID NO: 7120 - DNA, 402 bp, Triticum aestivum
  Clone ID: LIB3281-048-P1-K1-C3
cggacgcgtgggttcgaagttgatcagcccaaggacttgttcctctactgctagtacggggcgatgatatatattgggctgaagaagttccgtaaagcattggagcttcttcacaatgctgttactgccccaatgtcgtcattgaatgcaattactgtcgaggcttacaagaagtatgtcctagtttcactcattcagagtggacaggttccgtcattccccaagtacacatcttcgactgctcaaaggaatctgaaaaatcacactcagatttacgtcgatctgtctacatgctatggtactggtagctactctgatttggagacattcatccagtcaaatgcagaggccttccaaactgataacaactttggactagtgaagcaagttctttcttcaatg

SEQ ID NO: 7121 - DNA, 329 bp, Triticum aestivum
  Clone ID: LIB3281-048-P1-K1-C4
gctccgtctcctcggatctccgcctcaaatttgcctccccaatccccagttccaggttcttggaggaggggggaagccatgggcagcttcgccaagctggccaagaggtgcgtggagacggaggcgccggtcatggtgaagatacaagagctgcttcgaggggccacggatgtgatgtcgcttgcgcagggaattgtttattggcaacctcctgaggcagccctgaacaaggtcaaggaaattgtatgggaaccagcaaccagtaaatatggtgctgatgatggccttcccgagcttcgagaagcacttctcgagaagcttcgcagaga

SEQ ID NO: 7122 - DNA, 367 bp, Triticum aestivum
  Clone ID: LIB3281-048-P1-K1-C5
accctgtactgcagctggaccttacgttgatctcagatcttgttgtcgtgattgtatctgctacttgtggtggaattgcctttgcttgccttggacaaccagtcattacaggttatttgcttgctggttctataattggccctggaggttttagctttgtcaacgaactggtgcaagttgagacagtagctcagtttggtgtgatatttctcctttttgctctaggacttgagttttctaccgcaaaactacgagctgtacgcgcagttgccgttcttggaggattgctgcaaattatactttttatgttcctttgtggtatttctgcgacgctatgtgggggtaaaacaaagggagggtgtttttg

SEQ ID NO: 7123 - DNA, 401 bp, Triticum aestivum
  unsure (1)...(401): unsure at all n locations
  Clone ID: LIB3281-048-P1-K1-C7
gttatgattgatgtgggaactaacaatgagaaactcctcaaggatcctctttatcttggcctgcaagaacaccgtcttgagggagaagattatgttgaaattattgatgaattcatggaagctgttttttctcgttggcccaatgtgattgtacagtttgaagatttccaaagcaagtgggccttcaggttgttgcagcgttacaggaagacttatcgtatgtttaatgatgatgtgcagggaactgctggcgttgcaatagctggtcttcttggagctgtaagagcacaaggaaggccaatgatagactttccaaagcaaaagattgttgtagcangtgctggcagtgctgggattggtgttgtgaatgctgcaagcaggaccatggcaaggatgcttgg

SEQ ID NO: 7124 - DNA, 386 bp, Triticum aestivum
  Clone ID: LIB3281-048-P1-K1-C8
ctcccatctgcatcctccctcccccacccgtaggccggcacggcagcccgatcccatcccatcccgacttcccgagcccagaaactgaaggggggagagagagaaggggagctgccacaccacctaaacaaacaagaggcggaaagcgaccaaatctcgcgagccaaatccaccgcacgggctttcccctcccctccccacgcgcgcgatccgggcggagatggacgccggcggggcgcagccgccggactcggagatggcggaggccggtgcgggcgctgcggcggcggcggggacggcgccgggcggcgcgatggataacatccaggccacgctcacccacggcgggaggttcatccagtacaacatcttcggcaacgtcttcg

SEQ ID NO: 7125 - DNA, 380 bp, Triticum aestivum
  Clone ID: LIB3281-048-P1-K1-C9
cggacgcgtggggtggcgctcggcgcctgtccctggcccgtcccccacggggccgatggcgactccgccgtcctccacacggccgtcaacaaagactacacgacgccgcgacaacgtagaagctcctcccttagcagatgcgttcttcctctgcgccacctgtggaacagttcgtgcgcccagtgccgccgattcgatggtctgcagatgtttgatctaagatgcccgactgtactacatgtacatggaagaagaaagctcaatgaaccgaagctggggaaaaggaataaccaaggaggggaggggaggtcacatccttgaagccaacggcaaattaaggcatcaccttgaatttgtaactccagtaactaaatggagat

SEQ ID NO: 7126 - DNA, 334 bp, Triticum aestivum
  Clone ID: LIB3281-048-P1-K1-D1
gaaacccgcggcggccacgcgtccgcccacgcgtccgagacctcgccccctccccctctcacctaatccgcggcagccgaatggtttctcacctcccagagcctcttcttcaccccgtcgcccgccgggccttcccggcgaggccgggggcgccccgtcaccatgtccgccgccgcatcgcacaactcgcaaccccgaaacaaccccttcgccgtctcatcctccgcccccaaatccgaatccaatacctccaaaaccgacctcgcccttggctccgccatcgccgccgccgactacggctctttcctgctcggctactcctgtggttttgggg

SEQ ID NO: 7127 - DNA, 293 bp, Triticum aestivum
  Clone ID: LIB3281-048-P1-K1-D12
ggatcaggtctagaatctaaagaagtccgctcaggcagtccttctggggggagacctgcaagaagacccgctaaagatgacaaattatcatcaagaaagtccagtgaagaagaatcttcaaagaaacaaccaacggccagtcccgatctgaggaaagaggactctctctctgatgaagacagtgatgaagatctcagtttgaaggaaatggcgtctcctaaatcaatgaccaagacgggaaaaagcaaaggccaaccaggggacagtggagtgtcaaaaaggaaacttgtgca

SEQ ID NO: 7128 - DNA, 407 bp, Triticum aestivum
  Clone ID: LIB3281-048-P1-K1-D3
cccacgcgtccgctccagtgatatggagacgcgtctccacctccatgcgttggcgatccttctggtcgtctcggcgcggcctccctccgtcgccggcgggctctgccgcgacagctgcggcgacgtcccggtgcgctacccgctgggcatcgacgacgggtgcggcagcccgtactaccgcaacatgctgacctgcgccgacaacaccacgctccgcctccgcaccccgtccggcacgtacccggtgtccggcgccgactacgcggacccgcacctggtggtgacggacccgtccatgtggacgtgcgcgcggcccttcacctacgtccacgccgcgcccttcagcctggacaccagcacccgcttctcgctgtccccgaggaacgaccacctgttcttcaactgcg

SEQ ID NO: 7129 - DNA, 321 bp, Triticum aestivum
  Clone ID: LIB3281-048-P1-K1-D4
tattcatcttcctcccgcacgcagaattagatcagggcgagcggggcagggaggatggagaacagcagcggccgggaggtgcttccgaacggaggaggagccggggggatgggcaacggcgcggcgaacgggagggcggtgcaggcgctgcagcggagcttcgccgaggtgcaggcgatcctggagaagaaccggattctgatccatgagatcacccagaaccaggagtcgctcgaggccggtggcctcagccgcaacgtcgccctcatgcgcgagctcaacagcaacatagcccgcgtcgtcgacctttacaacgccctt

SEQ ID NO: 7130 - DNA, 356 bp, Triticum aestivum
  Clone ID: LIB3281-048-P1-K1-D5
catcacatgcgtatagtaagtactacgtactagctatcttgatttgatggcgtttccttttcgtagacatggcttttcctttctcgtttcttaaagcaatcatcactcctcctttagtcttagtgcagcaaagtctttattggtccttaaggatgtctggcatatacttagaaactaagaatatgcaaagacaacgattacattctgtcgatcatgtaccaagtacaacattatcctggttaatgcaaaatccagtcatcctctaatccttcaggttaatggtatcttttttggattataggctttggcaggtgggccactggtgcaagctcgaaattttgcagtcatgactggtg

SEQ ID NO: 7131 - DNA, 360 bp, Triticum aestivum
  Clone ID: LIB3281-048-P1-K1-D6
cggacgcgtgggcccccgcctgcctccccccgatcgccaaactccccgagggcgccgcgcggccaccgcgcccgcgccataaatcaagctagcgctgcttcacttgaacaacgccgcacctcaccgccaccgcacacctcccctgccgcgccgccgtgacagcgtaggaaggaagagcgagcgagcgtttgttggcgcagcggcggcggccggcacggcaagatgatcacgggcacggacttctaccacgtcatgacggcgatggtgccgctgtacgtggcgatgatgctcgcgtacggctccgtcaagtggtggcgcatcttcacgccggaccagtgctccgggatcaaccgcttcgtc

SEQ ID NO: 7132 - DNA, 405 bp, Triticum aestivum
  Clone ID: LIB3281-048-P1-K1-D7
cggacgcgtggggtctcggtcattcctctctctctctcccttgcttggggaagaagaagaagaagaagagagggcaagcgcccccgcctcccgacgccgtcgtccctcgccgccgatctgatctcaggagccagcgaagatgcattccaccaatctgctcctcgaggagcccatccggatggtctccatcctcgagccatccaagccgaacttcttcccggcgatgacgaagatcgtggggacgctgggtcccaagtcccggtccgttgaggccatctccgcctgtctaaaggccggcatgtctgtggcccgtttcgatttctcgtggggggatgccgcgtaccaccaggagacactcgagaacctcaagctcgccatcaaggccaccaagaagctatgtgctgt

SEQ ID NO: 7133 - DNA, 362 bp, Triticum aestivum
  Clone ID: LIB3281-048-P1-K1-D8
tgcagagtgcagggactacttcagcaagtccctgttcgtggtgggagaggtcggggggaacgactacaacgctcctctcttctccggcgtcgccttctccgaggtgaagacctacgtgccgctggtcgccaaggccatcgccaacggcgtcgaggtatgaaactaaaacccatggaggtagaaatgtagggtcaccttggcattgcatcatatagaagccgtagaaaatccaacggaatgcacacacacacatggccaaagtagaaaagtagcgccaggtgtgcaatgtacttgaagattccagtttcagggggatcatgcaagtgtgtcatgggtgcgaattcccggcaacacacatttgt

SEQ ID NO: 7134 - DNA, 404 bp, Triticum aestivum
  Clone ID: LIB3281-048-P1-K1-D9
caaggcaatcgaccttccttggatggcagcgatgaggattcaatgcctctgccaaatccaatggttggatttaacctgcctggttacagtggaccatcagtgacccgaatgctttctaaactagataccggaccaccttttttctattacgaaaatgtggcccgagctccaaaaggtgaatgggcgaaaatttcaagaaatctgtttgacattcagccagagtttgtggattctcttcatctgtgtgcagctgcaaggaaaaggggttacatccacaatttgccaattgagaacagatcgcctcttcttcctctgcccccaaagacaatatttgaggcatttcctcattacaagaagtggtggccttcctgggacacgagaacacatctcaattgcttacaaac

SEQ ID NO: 7135 - DNA, 315 bp, Triticum aestivum
  Clone ID: LIB3281-048-P1-K1-E11
cggacgcgtggggccgagctcctcgcgattcccaatccccgcacgccggctcgccctcctcctccggccccgccgccgccgccgcctcgccacaggctcacggttattcaagatggaacacaaggaggcgggttgccagcagccggagggcccaatcctatgcgttaataactgtggcttctttggcagtgcggcgaccatgaacatgtgctccaagtgccacaaggagatggtcatgaagcaggaacaggccaagctggctgcctcctccttcgatagcatcgtcaacggtggcgacggggggaaaagcccctg

SEQ ID NO: 7136 - DNA, 280 bp, Triticum aestivum
  Clone ID: LIB3281-048-P1-K1-E12
agcggccgctcgtgatcaacaatagcggccctctacattatcagccggcctcaccaaccaccagcagtgctgtgctgtgctgtgctggtacgaaaaaccacaatacaccaacgaccagccggccagacagccagccgccgcaaaccatggagaatagttcggcggaggcgaagcatcatcccagcgcggcatgttctgcggcggaagaagaggaggagaggaggaggaggtggtgcacatcaaggacgccgcgaagatgctcgtcgagcaccacgtgaag

SEQ ID NO: 7137 - DNA, 407 bp, Triticum aestivum
  Clone ID: LIB3281-048-P1-K1-E2
agaatcccccgctccaatagccatctcctctcgccccagccctcgtcgagcgcgcgcgttccaggagcttccggtgccggcggcgccatggcttcggagaccgagaccttcgccttccaggccgagatcaaccagctgctctcgctcatcatcaacaccttctactccaacaaggagatcttcctccgtgagctcatctccaacgcctccgatgcgttggataaaatcaggtttgagagcctgactgacaagagcaagctggatgctcagccagagctgttcatccgtataatccctgacaaggccacgaacacactcacacttattgacagtggtattggtatgaccaagtcagacctcgtgaacaaccttggtaccattgcgaggtctggcaccaaggatttcat

SEQ ID NO: 7138 - DNA, 301 bp, Triticum aestivum
  Clone ID: LIB3281-048-P1-K1-E3
ggccaagtgcaagtattaaatgataagatgctgaaacttgatggtgccgactgagcagttttgctccttgcagctgcaacctcatttgaagggccatttgtcaagccttctgaatctacacttgatccagtgacatcagcattcacaacattaaatatggctaggagcatgtcatatgcacagctaaaagcttatcacatggatgattaccaaagtcttttccagcgcgtgtccttgcaactttcacgaggctctaatggtgtacttggaggtagcactttggctcacttacctgagaata

SEQ ID NO: 7139 - DNA, 268 bp, Triticum aestivum
  Clone ID: LIB3281-048-P1-K1-E4
gagggcctcctcggcttctcgcctcctttaatcctctccccacgcgaaaccgtgggcgctctcgtctccctctgctcctcgctcctccgccccgtggcacccggccctccaaaaccctagccgtcgccgcctctcgatctaatgctgtgacctcccgacaccgtccccgcctcctcgcgtcgcgatggaaggccccgtccctgccccctcctactcctccgccgcacccgccgtcgctagggttccggccgccgcgccctacgctgcc

SEQ ID NO: 7140 - DNA, 339 bp, Triticum aestivum
  Clone ID: LIB3281-048-P1-K1-E5
attctcttctctcctcctcctctccgcccccgcaccaccaccatcggagagagagccagcgggaagcggggagggaaatcaatccccatgcccccgcccctcctcgccggaccagatccccggcgggccggcgcggagccgtaggcggggaccggcccggcccggccgatgggcggggaggccccggagccgcggcggctcagccgcgcgctcagcctggacggcagcggcgtcccggaggaggcgctgcacctggtgctcggctacgtggacgacccgcgcgaccgcgaggcggcctcgcttgcctgccggcggtggcaccacatcgacgcgctcacg

SEQ ID NO: 7141 - DNA, 303 bp, Triticum aestivum
  Clone ID: LIB3281-048-P1-K1-E6
aagagagcggcgggtggttggcagatggctgcggcggagccgtcggggtggagccagccgggtgctccaggaaggtggtctcttcacgggaagacggctctcgtcaccggcggcacccgcgggatcgggcgtgcggtggtggaggaacttgcggcgctgggggtggccgtgcacacctgctcccggaaggaggcggagctgggcgagcgcctcaaggagtgggaggccaggggcttccgcgtcacaacctccgtctgcgacctctccgtccgggagcagcgggagcgcctgattgccgacgtc

SEQ ID NO: 7142 - DNA, 405 bp, Triticum aestivum
  Clone ID: LIB3281-048-P1-K1-E7
acccagaggacggttcgtggcggcgagggtgagggcgtcggcggaggcgatggcgacggagaagctcggcgtcagggtggagcgcaacccggccgagtcccgcctctccgagctcggcgtccgccagtggcccaagtgggggtgcgataagagcaagttcccgtggacctactcggccaaggagacgtgctacctgctgcaggggaaggtgaaggtgtacccggacggtgaggaggggttcgtggagatcgcggcgggggacctggtggtcttccccaaggggatgagctgcacctgggacgtcaccgaggccgtcgacaagcactacaagttcgagtagcctgcacctacagcgctgcacgcacggccggccgctatgctgcctgctgccgctactagcactag

SEQ ID NO: 7143 - DNA, 401 bp, Triticum aestivum
  Clone ID: LIB3281-048-P1-K1-E8
cggacgcgtgggtacatgttctaaacattatacagtactttcgttgttaggtccaaacaacttgggatcttctcttctgcatgcagcaactggcttaccagtacaccgccaagggggcatgccttgccctggtagcaaggagggagtggagcctgtggcaggtcgccgaccgcgccttcgagctcggcgcgcaggacgtgatcattctccccggggacatcgcagaccccgacgactacaacagatttgttcaggccacaatcgaccagtacagccaatggcgaccgtggaaggcatgatgatagttcaaattggcattctgttagtccagtgtaatgaaggtcatggcctagtcaagtatggtcgcccattaagtcgtgcatatgttttatatgattgga

SEQ ID NO: 7144 - DNA, 400 bp, Triticum aestivum
  Clone ID: LIB3281-048-P1-K1-E9
ggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattattgtgctcttat

SEQ ID NO: 7145 - DNA, 406 bp, Triticum aestivum
  Clone ID: LIB3281-048-P1-K1-F1
atccaggacaaggagggcatccctccggaccagcagcgcctgatctttgctgggaagcagcttgaggatggccgtaccctggctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgaagatccaggacaaggagggcattcccccggaccagcagcgtcttatctttgctggcaaacagctcgaggatggccgcacccttgcggactacaacatccagaaagagtccaccctccacttggtgctcaggctccgtggtggtatgcagatttttgtcaagaccctgaccggcaagacca

SEQ ID NO: 7146 - DNA, 315 bp, Triticum aestivum
  Clone ID: LIB3281-048-P1-K1-F10
cggacgcgtgggtgaagctcccatacccatctagatcttttgatatggccgattgctcacgctgcttaatcccttggaaatcaaatgatggaatgtacatgatggaagtggatcgggttcttaggcctgggggttattggatattatctggcccgcccatcaattggaagaaatattacaaaacatggcaaagatccaaacaagattcagaggaagaacaaaatagaattgagaacattgctgaaatgctttgctggaataaaatatatgagaaggaagatactgttatttggcagaaaaaggtaaatttgaatg

SEQ ID NO: 7147 - DNA, 392 bp, Triticum aestivum
  Clone ID: LIB3281-048-P1-K1-F11
ataaggggtcggcggcgcagcaggtggtcgacatctccgacgaggaggacgacggcggtgatgaagaggagggcggtgacgatgacgacgacgacgacgacgacgacgatgacgaggaggatgacgacgaagtcgacgaggaggaagagcccgaggaggagctaggaactgaatatctggtgcagccgcttggccgtgctgaagacgaagagcattccagtgacttcgagccagaagaaaatggtgatggtgctgaggacgaggagattgaggatgacgatgctgaggatggtgaggatcctgtcaaggcgcaatcctcatcaaagaggaagaggtctggtggggaggatgaagatgatgacgacggtgatgatgattgtgatgatgatgag

SEQ ID NO: 7148 - DNA, 199 bp, Triticum aestivum
  Clone ID: LIB3281-048-P1-K1-F12
cggacgcgtgggtggagttatcctaagtgttcaattatacctagttggccgacttcccaattcaatagtacaaccaccactctaattacaacaaccactacttcaaccttaaccagaacaatgactactaagtctactattatttttttcccttcaacgcttactgaaatcaactagtggtatccaagctcagatttct

SEQ ID NO: 7149 - DNA, 408 bp, Triticum aestivum
  Clone ID: LIB3281-048-P1-K1-F2
cggacgcgtgggcccggacacagagcccgtgcgctcgaacgctcgtcgaaaagagaaaaactcgcggcagcacccatctctattcccgaactcgccggcgacgagtgacctatggcggacggcggcgagatggacgaggaggcgatgatgcgcgccttcttcccgacctcatttggcaaggcgcccacccgccccagcgccgcctcccactcctccaccctccgcaagccccaaaaccctagctccaacccctccacctctgccgccgccgaggaggacgatgtcggtggcgccgttgtcggaccccctaggccgcccaaggaattggctcctatccaggaggatgacgaggagggtggcggtctgattgggccgcctcggccgccacagcggccgtctgcgcacgcg

SEQ ID NO: 7150 - DNA, 382 bp, Triticum aestivum
  Clone ID: LIB3281-048-P1-K1-F3
tcggcaccgagggccggtgcaacaaccggggggaatgggtgtggagcctgcacggagaggcgcgcgtgctggacgccgtcgacccgcggctcggcggagagtacgacgagggggagatgcgtagggtcctgctcgtgggtctcgcctgctcgagcccggagccggagcgccagccgatgatgcacgcggaggtgcatatgcagagcgtggaggcgcacctttcgtaggtgcctaatggtgagctctgtcaggagcactatggccaactaacatctgaagatctgtcaggaggataaagtatctgactacaatgcaccgatgcttgactgttcaagcttcaactagcttaataatttagagaagcctactgtaaacctgatta

SEQ ID NO: 7151 - DNA, 244 bp, Triticum aestivum
  Clone ID: LIB3281-048-P1-K1-F4
cccctagttcgcccacgcgtcctcggacgcgtgggatgcggcaacaacgtggcggaatggctatgaagcgtgaacgaaacgtttcttatgctctacaccgtgtagcccaatattgtggggcagtatcacgaggtggagatgcttaggattctacttgaacgtctactctgatcaagctcggagcctgaggctcagacgtgtaacaacaaaaaaaaacatatgctgacctaggagtagaacccga

SEQ ID NO: 7152 - DNA, 365 bp, Triticum aestivum
  Clone ID: LIB3281-048-P1-K1-F7
caaagatcatctatgccttcatctcaaactgggctaagctggctgtcacgggggtcaagctaaagcagttccaaggtgctgtagatgctgctcgcaaggctaacagcgctaaaacatggaaggaggtctgctttgcttgtgttgacgctgaggagttccgtctagcacaaatctgtggtctcaacattatcgttcaggttgatgacttggaggaagtgagtgaatactaccagaacagaggatgtttcagtgaacttatttccctcatggagagtggtcttggacttgagcgggcacacatgggcatctttactgaattgggagttctctatgccagataccgccctgagaagctcatggaacac

SEQ ID NO: 7153 - DNA, 402 bp, Triticum aestivum
  Clone ID: LIB3281-048-P1-K1-F8
cggacgcgtgggctgccctagaggaggcaggacgagacgagacccttgggggttggttgttgcgggggcgcggtttctggccgcgccgcggtgctctacgtgcgtgggatgggtgcgccgaagcagaggtggacgtcggaggaggaagccgcgctcaaggccggcgtggccaagcacgggccgggaaagtggcggaccatcctccgcgacacggacttcagcgccgtcctgcgcctccgatccaatgttgacctcaaggacaagtggcgcaacttgagtgttactgctggaggatatggctcaagagaaaaggcaagaatggcgttgaagcaaggcaagcgtgttcccaaggttaacactgaaccaatggacgttgatgcagataatctggacaatgttcat

SEQ ID NO: 7154 - DNA, 400 bp, Triticum aestivum
  Clone ID: LIB3281-048-P1-K1-F9
cggacgcgtgggtggaagttccttccggttccagagagatcgcggaggaggatgatgggagggcgcgcggtgctcctgctgccgctgctggtgatcacggcgctgttcgcgcagatccgcgcgtcggatccgttgttccacgagtccttcaacgagagcttcgacgggagctggatcgtgtccggcaaggaggagtacaaaggtgtatggaagcacgcgaagagtgatggccatgaagactatggtctccttgttagcgagccagccaggaaatatgccataatcaaagaacttgattacccagttactatgaaggatgagacagttgtcctgcagtttgaagtgaggcttcagaatggccttgagtgtggaggtgcttatatcaagtacatccgtcctc

SEQ ID NO: 7155 - DNA, 386 bp, Triticum aestivum
  Clone ID: LIB3281-048-P1-K1-G1
cggacgcgtgggttccctcccccccgaaatctgaatccaaatctcggccgacgccgccgccccatgcctccctcgccgtcgcagccgccgccgccggccacggaggaggtcgaggtggaggacgtctcggacgacgagacggtggagggagaggcgccgccacttgccccggccccggctccggctcctgccccgccggccggcggaggtgccgaggcgagccgtgccgcgtcggggtcgggggaggcggcgggcggagaaggggccgacgaggaggaggaggacgaggatgaggacgaagaagacgactccgacgacgaagaggacgaggattccgaggatgaaggggacgaggacgaagacgaagactccgacgaggaggggga

SEQ ID NO: 7156 - DNA, 289 bp, Triticum aestivum
  Clone ID: LIB3281-048-P1-K1-G10
gggatatgactattcaagctatagctagtgaaccctctagcaagtctgccttccagaccttcatggtggtcatggtaaaagggaagatgggtgttgtacgcacaataaaatcactagtggaccagtctgctgaatactgtaacatgcaacaggcaaatgcagtaattcatgctctgcaaaacgagaacaaaatccgggagtcacacaattctggtgttgatatacttttctcgttgcgagatcttcagctgggcgctattggagatctaaaggttattgtcccaagacg

SEQ ID NO: 7157 - DNA, 299 bp, Triticum aestivum
  Clone ID: LIB3281-048-P1-K1-G11
ccaagcgcgagcgacagccagctccgcctcaacctcccggcgcatctgcgacatggcccgcaccaagcagacggcgaggaagtccaccggcggcaaggcgccgcggaagcagctggcgaccaaggccgcccgcaagtccgccccggccaccggcggcgtcaagaagccccaccgcttccgccccggcaccgtcgcgctccgtgagatccgcaagtaccagaagagcacggagctgctcatccgcaagctccccttccagcgcctcgtccgcgagatcgcccaggacttcaagaccgacc

SEQ ID NO: 7158 - DNA, 352 bp, Triticum aestivum
  unsure (1)...(352): unsure at all n locations
  Clone ID: LIB3281-048-P1-K1-G12
caaccagcgctccctggtcaggccgccccctccccttcgtcaccaccgccggcgctccctggtcaggctgccctccccttcgtcaccagcgtcgccgctccctagcaggccgcccctccccttcgaatcagatcacataagtggccgaggaggtcctcgagctcggcatgctcgcgccagtgctaggcgccgttggatgcggacgcggaggctcgggacttgcacgccctactctaccctgttccttccaatccggccccgaagtgctcgaggaggcgctcgaggtcggcatgctcaccggcgacgctgggtccctccatcctnctggttccctcggcatcggcaacatgag

SEQ ID NO: 7159 - DNA, 404 bp, Triticum aestivum
  Clone ID: LIB3281-048-P1-K1-G2
ctcctcagtctcggagccaggggcgatccgtcgacctcgcctctccgccgccgtaatctccttcttctccgttactaccgtgagctgagtgagatcgataaagagtggaggtcgccagttcagcctcaagagtgaggggagagtctcaggcttgggaaccttttcctttggacacatagcttgataaaagcaacacccgggtgtcgctgaagaagcatagatcggggagttttcttggcctgagaagtacaggagaggagagtagtgatagcatggcttcaaagcttgtggttcttggaatcccttgggatgtggatacagaaggattaaaagagtacatgagcaagtttggccccctggatgattgcattgttatgaaggatcgctcatctggtcgatctcgt

SEQ ID NO: 7160 - DNA, 384 bp, Triticum aestivum
  Clone ID: LIB3281-048-P1-K1-G3
tcggcaccgagggccggtgcaacaacctcggcgaatgggtgtggagcctgcacggcgaggcgcgcgtgctggacgccgtcgacccgcggctcggcggcgagtacgacgagggggagatgcgtagggtcctgctcgtcggtctcgcctgctcgagcccggagccggagcgccggccggggatgcgcgcggtggtgcagatgctgagcggggaggcggacccgccgttcgtgccggcggcgaggccgtccatgagcttcagcgccaaccaccagctgctgctgagcctgcaggacagcgtgtccgactacaacgcgctggggctgaacccgtcggacgactcctcgtccgactcgctgagctcgtcgtcgctcaccagcacgctgg

SEQ ID NO: 7161 - DNA, 201 bp, Triticum aestivum
  Clone ID: LIB3281-048-P1-K1-G4
cccacgcgtccggaaccggacatcgcagattattagattaggtcaggtgaagcgcttggcctatcatgagctatttaaacattttctatgacctgtagcctgtaggccaatactgtggtgcaccctcttgtcctgatctggattggaattagagttcaacgcttactgtgatcaactagtggtatccaagctcagatttct

SEQ ID NO: 7162 - DNA, 363 bp, Triticum aestivum
  Clone ID: LIB3281-048-P1-K1-G5
cggacgcgtgggagcgcattaaaggaacaaaacggaacgttgaggtgtggcaagccctacttgctgttagagagttggttcttcctcctaatgaagacagagatacctggataaaatttgctaaactttgctggaagagtggacgtattagtcaggctaaatctactttagtcaaacttttacagtttgatcctgaatcttctcctgagttgacactgtatcatggacatcctcaagtagtcctggcttacctgaagtaccagtatgctgttggagatgagcttaaacgaaaggacgcattttctaggctacaagatcttgcagtgcagattgcaacagccacaaatagttactctggaatgc

SEQ ID NO: 7163 - DNA, 313 bp, Triticum aestivum
  Clone ID: LIB3281-048-P1-K1-G6
gaagagtcgaaaatgcttcagccacacggtccgtcaactgacgccaagcgagagcagcgctgaacggctgcctctcctcccctgccgcccgccgccggcgacggcgagggcaggtgttcgacgaaatgtgcgcgcgggggccatccgccagggactggtccgagatgcccctggacgctctcacctgcgtcttcgccaagctcggagccgtcgagctcctcatgggcgcgggcctcgtgtgccgctcctggctccacgcctccaaggcgccagagctgtggcgggccgtggtgatgtcgcgcccgcccgacac

SEQ ID NO: 7164 - DNA, 282 bp, Triticum aestivum
  Clone ID: LIB3281-048-P1-K1-G7
caaacgcctaaaatcccataaacacaccatacctcaacttacaccaaggtgaagcattactgaacggttgacacttctaccttgccgcccatcaacaccgacatacatggctaaaattcgacaaaatgtgctcgcggagtccattcatcaggtactgtaacaatatccccatcaacacctctcacctgcatattctccaagctctgatccgtcgacattctaatatgcacatgcctaaggtgccgttcctgacttcacgcctcaaaatccccatagatatga

SEQ ID NO: 7165 - DNA, 403 bp, Triticum aestivum
  Clone ID: LIB3281-048-P1-K1-G8
cccccagccgccacaccctttcttctccatggctcggctcccctcccgcgtgcgtccctgcggcgcctgtgtatggatgaggaggtcgagggcacgagcaaggatcatgccgaacaggggcgcaatggggtggccggggagcgcgcggtgtctggagagacaaagatgctcctaagcagaggacggcgcagcgctggcttctcctctccccccgctgcctgcacacctcgccgatgtctgctcgtcatccgagacaactagcgatgataataccttggatgcgagtgatgatggattctttacttctggaagttcgagtgatgaagaggcagatggcgagcttaccgataaaagtacagcgttggcgatgaagcctgctggcctttttcttgaagcaattctt

SEQ ID NO: 7166 - DNA, 399 bp, Triticum aestivum
  Clone ID: LIB3281-048-P1-K1-H1
gccgccgcctcctctcggttccttctccttcctcggagccatgggtaaagaggggactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccac

SEQ ID NO: 7167 - DNA, 325 bp, Triticum aestivum
  Clone ID: LIB3281-048-P1-K1-H10
ggtctccatatttgatgttgaaacacataccaaaaagtcaccctgcagggccacaacacaagtgcagtagtgtgctgggataacactgggagtaccttggttgtagcagattagtagggggcagtatataggagagtgcttatgggtcagctaaaggaaataagtcattttggtgtccacccagtatcaatcttgggattggggtccacttgagctatggacatggtaagaccaagcatgcgaccgcgcacgaggctgatgcttttgcacatcacgtaccggttggggtttggagcatgcactcgtcagtgggagtacatatata

SEQ ID NO: 7168 - DNA, 142 bp, Triticum aestivum
  Clone ID: LIB3281-048-P1-K1-H11
cgcggacgctttggcttcgattgttcactcaccgagcaccgacaccaaccctgggggctttcaacagacagcgcagaacgccgacgctcatggcacacaaccctggggcacgctgtgcgcgtcctgaggccactcatactac

SEQ ID NO: 7169 - DNA, 298 bp, Triticum aestivum
  Clone ID: LIB3281-048-P1-K1-H12
aagatgcaaaacatattccaagcacatcgcggaacaagagatgcatcatgccgataacacgcatcaccggtgtgtttccgccactgctcgtggcaaatgcataatactatctagcttgtgcttgcaaacagaatgtccgtgagcagatattgcttctcaaattattcctttttccagccgcagagcagtcacccagcacaggctaaaacagggctgctgcaatctattcttcttgtctcctaggatgaaaatcccaatctgacagatggcccaacaagcattaataaaacaaacaaac

SEQ ID NO: 7170 - DNA, 399 bp, Triticum aestivum
  Clone ID: LIB3281-048-P1-K1-H2
cccacgcgtccgctcgcacgccatcttggcaagcactctctcctcccccagcgggccgtcgagctccggctccggcagacgcaagcaggccacctcggacgaattcttcttcccctactcctcgtatctaccgcgatggcgtcgggtggagatctcccatccgggtttgctgatgagagcacaagtacgaaaacagaaggatcatccaacgaacgtcaaggggttcctccagctgccgctgcaggcttgtcgggtcctttcgatttttcttctatgcaaagttcgctcaatgatccatctataaaggagatggcagaccagattgcaagggaccctgcattcaatcagatggctgaacagctacagaaaggtgctcagactgcaagagaacagggcatg

SEQ ID NO: 7171 - DNA, 392 bp, Triticum aestivum
  Clone ID: LIB3281-048-P1-K1-H3
cgagttcaatgcacgtaaaccagaagagctgaacatatttgaaggagtttcaagaaaccacctctttttggccgttgtgagcgtaaccgtcgtgctgcaggtgataattattgagttccttgggaaatttacatcaacagtgagactcagttggcagctctggcttgtttctcttgctattgcttttatcagctggccgttggctcttgttggaaagttcattccagttccccagaccccattgaagaatttgatcctgaagtgttggccaaaaaagaagaagcaaggtgacgaaggagcagctcctccaccggtgtgacactgaacgtctctcccaagtggcagaaatcatcagctgccaaaattccagttctggtgcatatagatgcttg

SEQ ID NO: 7172 - DNA, 256 bp, Triticum aestivum
  Clone ID: LIB3281-048-P1-K1-H4
tgccaatctgagctcagactcgtaagttattgcgatatgttcaccatgctgaggctatcacagtacgagcaggcactgtgctctgataacactggggagtaccttgcgtctgtcagccaggatctagttaaggtgtggtcagtatcatcaggagagtgcattcatgaggtcagctcaaatggaaataagttccattcttgtgtgttccaccggaggagcatatgctgagcggtgaggcggacccgccgttcgtgcc

SEQ ID NO: 7173 - DNA, 350 bp, Triticum aestivum
  Clone ID: LIB3281-048-P1-K1-H5
cggacgcgtgggcggacgcgtgggctttgagatccaacatggtaatgaagagacattcagggagatgcttcgcatcaatcgtacagtggccgctagccgcagtcagactcatttcatccttccggagtacctgatgcaaagggaccagaggctaaacatggatgaggcggtcgacactctgacgcgtgccggtgtcccgcaggatgagatggccgccttagaaaggcagctagcttctggaccatccccggcgccagcagcggctccaagcaccagtacgactcctgcaaacagaatgatgaactttgttagtgccggagtagaggcacgggccgagagcagcacgcaac

SEQ ID NO: 7174 - DNA, 398 bp, Triticum aestivum
  Clone ID: LIB3281-048-P1-K1-H7
ggagaaggggcatgttgaggctgtgcgtgaggtattgaagttttgtgatggtcagtcagctgggctgaaggcaaacaatagcttcgatgcattccatattgcagcgaaacatggccatctggatgttatgcaggagctattgcgggcatttcctcaggtacattatacatcaacttctctgaataccacagctttagacactgccataacttcgggccacattggcattgtcaaatttctactggataccgagccaagcctttcaaggattgcaaaaggtaatgggatgacagtcttgcattcagcagtatcaatgggaaatgtggaggtggtagcgttgttattgaataaagacccggggattgcttttagaacagacataaagggacaaacagcac

SEQ ID NO: 7175 - DNA, 364 bp, Triticum aestivum
  Clone ID: LIB3281-048-P1-K1-H8
gtcggacacgtgggcgcgtgccctcctcctcctcctcccggccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctcgacttccagctgcaggagggcgggcgcaagctcaaggtggacgcctggttcggcacccgcaagaccatggccggcatccgcaccgtcatcttccacggtcagaacctcatcaccggggtcaccaagggcttccgctacaagatgcgct

SEQ ID NO: 7176 - DNA, 379 bp, Triticum aestivum
  Clone ID: LIB3281-048-P1-K1-H9
tgcgattggagtgcgttcagaccattttctcttcccatctccatacatgcgccacgcctccacccagagttcccaattccacggcctccgggcctcctgccgccgaagcaagctcgccgcctccacggaattcttctgcccccttccaccgggccggcgtggagccgagatccgtccccgctgattcattcttctggtctggttagagattcgatcgctccatctacgaaacaaaggacacataaaagagcaaaggtgcctgtggggaaaaccccgcgttactttttgtaacttaggaggtgaaaggaagagaggactagagacgaggaaataataatgggaaagggagatgtggccactaagtccaaatcccagaaat

SEQ ID NO: 7177 - DNA, 236 bp, Triticum aestivum
  Clone ID: LIB3281-049-P1-K1-A10
gatggacctaatcgaagaccatggtctagctgtcgtggcaggctcttgcagtaaactgcaagagctgcgggtcttcccgtctgacccttttggtgccgggcaagttttattgactgaaagaggccttgttgatgtttctgccagctgccccatgttggagtcagttctctacttctgcggccagatgacgaatgaggccctcattacaatcgcaaagaaccgtcccaacttcactt

SEQ ID NO: 7178 - DNA, 365 bp, Triticum aestivum
  Clone ID: LIB3281-049-P1-K1-A11
cggacgcgtggggcgaggttttttgaaagcgtcctctctctcctctccatcaacaactgcccccgacacccaacggcagccgtagcgcgagcgaggagaggggggataaaaagctctgctctttaacgcccgcccctagggtttcgagccaccgcgcgccctcgctccctccctcccttcccttcgcgccatctcccgccctccccccgatcggctcgccccctcccggattcgatcccccgccccgctcgatctggttctcctggtgatgagggggcggtagatgggggccatggcggaggaggcggaacacgagggctgcgtggagaaccggcagcccctcgcggcgtcgagcgagtcggtgt

SEQ ID NO: 7179 - DNA, 390 bp, Triticum aestivum
  Clone ID: LIB3281-049-P1-K1-A12
cccttctgttctgttcgagagaggcgacagaggaggcgtctcgggcccggcccgatcccggatcttcgccgccggcgacgccggtcggagaggagatgggggaggagctcggagcgccgctgtagatagtagatgtagcctagctgtttccttactggagtttggcctcgtgccggagtttggcgtcatgccgatggggaccttgccgccggcgcgcccgagccgcgtgcggtggttttcggaggggctcctgatggtgtggtgattggttcgctgctgctggtcggaatcaagccggagtcctcggaaataaagctcgtgggtgtcccagatctggagctcaagctccttcttccccacttcttctcgagctgccatggaggtggactg

SEQ ID NO: 7180 - DNA, 438 bp, Triticum aestivum
  Clone ID: LIB3281-049-P1-K1-A2
atgagaccctagaagacgaatacaggacccgagaggacgaatatgaatatgaaaccctagaagaatctaaatatggaatcctagaagacgaatacgaatatgaaaccctagaagacgaatatgggagcccagaaaacgaatatgggaacccagagaacgaatataggactttagagaaagactcagaagaggaatatgggagcccagagagcaaatataggacccaagaggacgaatatggaactctagaggaagactcagaagacgaatatggcagccccggggaaagcgcagaggaaaaatatggtactttagaggaagactcagaagaagattcagaggacgaatacgagagcccagaggaagattccatcttaaaaaaagagggtttgattgagcatcgaggaacaaaagaatttagtctaaaataccaaaaag

SEQ ID NO: 7181 - DNA, 425 bp, Triticum aestivum
  Clone ID: LIB3281-049-P1-K1-A3
cggacgcgtgggtgcacgcgcctccggcctccgctccgcctcagccatgggggccctccgcttccccgccgccaccttcgcccacctccccaccccgccgcctccccaccgtgccgccatcgccgccgcaattgccgccgccgcggctgcggcagccgcagccggcttcgccctgaccgccaaatctgccggtcggccgctcccgcgcccgtcacactctgcatccctctgggcctccctctcccttgccgacagcggcgcccccggcaacgtcgagccccgcaccggggccagattccccgccgagaccgccggcgggcgccgcctcctcggcgttggcctccgcaagaccaccatccttggcctcaagttcatcgacgtctacgcgttcggcggttatgccgatgacagcgaactgaagcagc

SEQ ID NO: 7182 - DNA, 279 bp, Triticum aestivum
  unsure (1)...(279): unsure at all n locations
  Clone ID: LIB3281-049-P1-K1-A4
cggacgcgtggggtcaactgacaaatcggctgtatattcagcatccttcaaagttccagatgtttatggcgtcttctagtcccacctncccatcctaacgcctacccaccgttccttcatctacgacgccattgtcttcttcttggctgccgcaccctcattctgattcttctttacttttcaatccacctgtctaccgatccccttccttcaatactatacatccctctcaaccttcctttcctttttcttcagatcctcctcccccaatctctagcc

SEQ ID NO: 7183 - DNA, 412 bp, Triticum aestivum
  Clone ID: LIB3281-049-P1-K1-A5
cggacgcgtggggcaagatggcgcctagcactcgtagggccagtgtcatcctcgtcgtggggatgctcctcgcgtctgccatggcagcggtggcggccgacgcagcggaggccgaggcggcggctgaggtgtcgtgcggggacgcggtgagcgcgctgatcccgtgcgggtcgttcctggtgggcgccgtcgccggggcgccgagcgagagctgctgccgcggcgcgcaggggctgcggaggatggcgggaacgccgggcgcgcgccgcgcgctctgcaggtgcctggagcagtccggcccgtccttcggcgtgctcccggaccgcgcccggcagcttcccgcgctctgcaagctcggcatctccatccccgtcagcccccacaccgactgcgacaagaaacagtgagcgac

SEQ ID NO: 7184 - DNA, 445 bp, Triticum aestivum
  Clone ID: LIB3281-049-P1-K1-A6
cagccagccgtcaaagcacgacacatccaggtccaagcaaagcatccccagccgagaccgcgtgcgctccacgcagcagccgccgagagaagtcgccgccggagaaggaggaggatgtcgtggcagacgtacgtcgacgaccacctgtgctgcgagatcgacggccagcacctcacctccgccggcatccccggccacgacggcagcgtctgggcgcagtcccccaacttcccccagttcaagcctgaggagattgctggcatcattaaagactttgacgaacctggacaccttgcaccaactggtcttttccttggaggcacaaagtacatggtcatccaaggtgaacctggggttgtcatccgaggaaagaagggcaccggtggcatcactatcaagaagacgggcatggccctgattctcggtatctacgatgagcccatga

SEQ ID NO: 7185 - DNA, 355 bp, Triticum aestivum
  Clone ID: LIB3281-049-P1-K1-A8
cggacgcgtgggctcaccgcctccgctcccacgccgccgaatccgagacctgatctcggattcaccgcagcgcgaccaaaccctcaggcgatccccggcacctcctccccgacgcttcagccatggcaggaatggcaccggaaggttcccagtttgacgctaagaactatgattctaagatgcaggagctgctgaaccaaggtgagactgaggagttcttcacctcttatgatgaagttcatgagagctttgatgacatgggtctccaagagaacctcctgagaggaatttatgcttatggttttgagaagccttctgccatccagcaaaggggaatcgttcctttctgcaaggg

SEQ ID NO: 7186 - DNA, 406 bp, Triticum aestivum
  Clone ID: LIB3281-049-P1-K1-A9
cccctcgcgccgccactttccaaatcccacatcgggatcctccctgatcccctcgtccaccttgttttccctgtcgctcaaatcagggcctcccctgccttcccaatccatcgatccatccaaccatcagccagccgcagcgcctccctgctcgatcgtgtgctcgaggcgcccgagcacctcgtgcttctcctcgtcggcggagacgagcaccaggaccaggccgtccccgcaccgcaccctgcctctacttctcttttgcttcttcccctacttcttctcttttcctcaccccggggtctttctctctttcttcaaggaggaccagagcttggccggcatgggcggcttattccggagcaaggttggtgggcttcttaaacaacccgggccaccaacgacaggt

SEQ ID NO: 7187 - DNA, 342 bp, Triticum aestivum
  Clone ID: LIB3281-049-P1-K1-B1
cccacgcgtccgaagaaaagtaagaaaaagaagtccaaatctgaggctgatggtgacgccatggatcttgataagcctgccaacacggccgcagcagaggaagggacagagaaggcgctcttcagagctcttaaaacgcgtggaaacacaccgaagtatggcctcatattccactcatcttttattggtcgtgcatcgaccaagaacaagggaagaatggctagatacctggcaaacaaatgctcaattgcttcacgcattgactgttattcagatatgagtagctcgattttcggtgagaaactgcgtgaacaagtggaggagagattagacttttatgac

SEQ ID NO: 7188 - DNA, 308 bp, Triticum aestivum
  Clone ID: LIB3281-049-P1-K1-B11
catacacccgtacaagctttacagattacttgataaattaatcatgctgaggtgctacctcgttccgagaaacaagatcgcatctgttgtaatatcatcacacataacgaggtaattgtcaggatgaacatacggaagaaacgtcctatgaggattattgaactgactagatatcagctgagcttacattaactttaacgacgttctttggatcaaataacgaccttacttgtatcataggatgaaaaggttcttattcttcatccattacgatttttttcttcgtggtcatctatcacgacactggt

SEQ ID NO: 7189 - DNA, 431 bp, Triticum aestivum
  Clone ID: LIB3281-049-P1-K1-B12
cccacgcgtccgcccacgcgtccgcggacgcgtgggcaagcccgcacgcgcacgcgtacccgcacccgcacaacagagacccagagcaggcgacacaccgcccaggcccagctccagctccggcgagatctccggcgacccttcgagatgagccgcggatcgggcgcgggctacgaccgccacatcaccatcttctcccccgagggccgcctctaccaagtcgagtacgcgttcaaggcggtcaagtcggcgggggtcacctcgatcggcgtccgcggcaaggactccgtctgcgtcgtcacccagaagaaagtcccggacaagttgctggatgacaccagcatcacgcaccttttttcgattaccaagtacaccggcttgcttgccaccggccttacagctgatgcgaggtccttggtcttccaagcaag

SEQ ID NO: 7190 - DNA, 414 bp, Triticum aestivum
  unsure (1)...(414): unsure at all n locations
  Clone ID: LIB3281-049-P1-K1-B2
cggacgcgtgggggggcganaaagtaaaagaagtccaaatntaaggttgatggggacggcattattttgttaagcctgccaacacggccgtagcagaggaagggacagataaggagctcttcatagctcttaaaacgcgtggaaacacaccgaagtatggcctcatattccactcatattttattggtcgtgcatcgaccaagaacaagggaagaatggctagatacctggcaaacaaatgctcaattgcttcacgcattgactgttattcagatatgagtagctcgattttcggtgagaaactgctttatcaagtggaggagagattatactcttatgactagggtgttgcaccattcatgaaccttgtattaaaaaaagctgcaattgaatgtctttaccaatttattttta

SEQ ID NO: 7191 - DNA, 403 bp, Triticum aestivum
  Clone ID: LIB3281-049-P1-K1-B3
cccacgcgtccgcggacgcgtgggccaaggttgtccaggacaccatcgacccgaatgcacggatcgagttccgtgagaacacccaggacgacccgcacaagcgcaagccagacatcaccaaggccaaggagcagctcgggtgggagccgaagatcgccctccgtgacggtcttcccctcatggtcaccgacttccgcaagcggatcttcggcgaccaagataacgctgccaccgccaccgaaggccagtaaagagtagaccggagtactatactttgaaattttggtggcctgcttctagcttgcttcttggttaatcccccccactgacagagctatggccacgtagtcgtcgtcgagagttttactgctaaataccttggttggtgatgtaatgttattca

SEQ ID NO: 7192 - DNA, 317 bp, Triticum aestivum
  Clone ID: LIB3281-049-P1-K1-B4
ctgacacctaagataaagattgagatatctacatacgtgacactcttcggccgtcgggacggactcagtaatgatcgaacgctaactaagacagttactagattaggcacaacttttagcatgacagactcgaacagtcgtgcattcttaagatcgcatttctaaattgtcttcccgtcaccctctttagtttcagagagcgagtcaacaacgaagaaggtctttttggcgaggcactggatagaatagcatacttcttagtcatcaaacacgattagtttttaataggaagctaatacccaagcatattatgtaat

SEQ ID NO: 7193 - DNA, 411 bp, Triticum aestivum
  Clone ID: LIB3281-049-P1-K1-B5
ctggaatcaaagataaagaataagatgcctacaaatgtgatactcgacggtgatctagatgggagctctaagcatcaaaagaaaagtaagagagttcccagattaggcacaagtattagcatgaaggactcgttcagtcggccatttttgaggaggcatttctcaattggctcccggtcaccccggttagtttcagagagcgagtcaacaaggaagaagggcttctgggcgaggcactggagagaatagcatagtactcagtcatcaaacaggaggggtcttgaagaggaagtgaactcccaagcaaatcatgtgggttttgtagtcaatgatgtgaaagatatttgctgtcgggcaaccatcgtactaaaaagttcctccactcgtcatgttcagagttgggaattctga

SEQ ID NO: 7194 - DNA, 441 bp, Triticum aestivum
  unsure (1)...(441): unsure at all n locations
  Clone ID: LIB3281-049-P1-K1-B6
cggacgcgtggggccgacgacgccgcccacccccaccacaccaccaccagacagagagaacacacgcaaggagcacgaggaggaggcaagggaagccgccgccgccgccgccccgttcctcctcgccggccggccgccacaggtttcaagatgtcaacctgcacgtttgcagcttcctgtgccctcttgggcaatgctcgaacaaccgatgccccccagaaagcggtcaagagccgcctgagcttcctcggccgaggcgcgccgcanctgcggagcctgaggtcctccttcccctccaagaagctggacgtctccgcggcggccacgtacaaggtgaagctggtgaccccggaaggggacgagcacgagtttgaggcgccggacgacgcctacatcctggactcggcggagactgcgggggtggagctgccctactcgtgc

SEQ ID NO: 7195 - DNA, 300 bp, Triticum aestivum
  Clone ID: LIB3281-049-P1-K1-B7
aatcaaacgaaaaaaaaagaagcagttggcggacggactggagatgagcggagccgccggcgagctcaccgcgccgccccgtcgccggcgatccggccgagcagcgcagagagaggagacggcgccgctgctggatcccgccgccgaggctccccagggccgaggtgcaaagagaggagggctgttggaccccgctgaggttccccaactccagtgggccgaccccattttcagctcgccgcgtgtgtacggtaggaagcagtggcgtgccgtgtgcaaagtgctcggcaacgacaatct

SEQ ID NO: 7196 - DNA, 186 bp, Triticum aestivum
  Clone ID: LIB3281-049-P1-K1-B8
aatacacctgaaaaaaaagaatcagttgtcggacatactgaacatgagcggtagacgtcggtgagctcaccaggccgtaccgtattcgagaatccaccacgagcagatgagagaggggacacggaaccgctgatgtatccacctcccgctgcttcgcatgaacgaggtgcaaatagaggagggctg

SEQ ID NO: 7197 - DNA, 302 bp, Triticum aestivum
  Clone ID: LIB3281-049-P1-K1-B9
ccttgatccccacaggcttttccggctactccattccttcttcgtgcctcggcgcggccttcggcccagagccttgccgccacctgctatttcttatcgcccatgccagctcggtggcgggatgaatggacaggggaggtgggcgacgagggctactccacccaccagattcgcgccgcccctgcccaaattctcttcgcgtgcgttggacccaatcccgtcctcgcttgtatcgcccgacggacaggtgcccattctcctgcgggtccccttcctttttttcttctcctccctcacgacat

SEQ ID NO: 7198 - DNA, 319 bp, Triticum aestivum
  unsure (1)...(319): unsure at all n locations
  Clone ID: LIB3281-049-P1-K1-C1
cccacgcgtncgtggtggccctcctggccgtgagcctggtcctcgaggcccaggcgggcagcggctacggcggcgggcacgcccccaccccgacgccggtcgccccaccccccaagcacgagaagccacccaaggggcacaagccccctaaccaccaccaccacgccaaaccaccggccgtcttccacgggccgtcgacgcacgctccggcgccacccacctacagtcccccgacgcctaaacctacccctncggcccctaaacccacaccacccacctacgccccgatcccgaagccgccgaagccatctgcctcgcc

SEQ ID NO: 7199 - DNA, 441 bp, Triticum aestivum
  unsure (1)...(441): unsure at all n locations
  Clone ID: LIB3281-049-P1-K1-C10
cagccagccgtcaaagcacgacacatccaggtccaagcaaagcatccgcaggcgagaccgcgtgcgctccacgcagcagccgccgagagaagtcgccgccggagaaggaggaggatgtcnnggcagacgtacgtcgacgaccacctgtgctgcgagatcgacggccagcacctcacctccgccgccatccccggccacgacggnnncgtctgggcgcagtcccccaacttcccccagttcaagcctgaggagattgctggcatcattaaagactttgacgaacctggacaccttgcaccaactggtcttttccttggaggcacaaagtacatggtcatccaaggtgaacctggggttgtcatccgaggaacgaagggcaccggtggcatcactatcaagaagacgggcatggccctgattctcggtatctacgatgagccc

SEQ ID NO: 7200 - DNA, 351 bp, Triticum aestivum
  Clone ID: LIB3281-049-P1-K1-C11
cggacgcgtgggcaggggtgactctagatcgaatccatccattagctggggggcttacgccttcccaggccctagacgcccgacaaccgaactcccaggcccccgacgccgaacttccaggcccgggaaaaccccatcttaggctcccgacgccgtcctgcccggctcccgacgccgtcatgtcaggctcccgacgccgacctccccgggccctcgacggcagctgatgggacgcccgacgccgccctcccaggatccccactccatcctcacattaatctcggcgggagctgtggttacgcccaacgccacccttacaggagctcgagtcccagctccccgggccttcga

SEQ ID NO: 7201 - DNA, 403 bp, Triticum aestivum
  Clone ID: LIB3281-049-P1-K1-C12
aattaaagggttggaggttatcagcaaagttggtgatctcatcggaatcaagtacttccccgttgagcaagagaaggttgcatctgttgacaaacttaagaagcttgagtgaatagtgacaatggacaattggaagaattctgctgctgttatgctagatctactgggtcatcttggtagtgcaccatgcctcggttttgctcttttgtgcacctcaggacccttcattttcctttgtctgaagtggttttgattttgtacagactgtattatcatccatcatagtttgaaacttaacacggctttatacactgttttgtcgaattcaagaaaaaagaaatccctgtacaaccttgtaagtgactgaaatcatgtagatactaatttccttattattactgac

SEQ ID NO: 7202 - DNA, 416 bp, Triticum aestivum
  Clone ID: LIB3281-049-P1-K1-C2
gcgcgcacaaaaaaagatggaaacctactccgacctcggcaccgacggcggcagccctgctccgacgaagccggcgatggaggaaccacgcgccgacgccactggaggtccctacatagttggccccgacgctgctcccgccccccagccgggtaccgccgccggcgcgaggaagcggaaggccccgacgacggcgacagcgaaggccgccaggaagcctcgcataccgcaggttgaagaaccgatccagatgcatgtgtactatggacttggagaaatgtttgacagcgttcagggcgatgatttagttgaagattcgttagacacttttgtagagaacaactgtgcacatgtcatcggcgagctaccgctgcagcccgaatcgatgtcattggtggatctacagctcttgatct

SEQ ID NO: 7203 - DNA, 295 bp, Triticum aestivum
  Clone ID: LIB3281-049-P1-K1-C3
ccgcccccaaaaaaagaacgaaacctacttcgaccttggcaccgaaggcggcagccgggcttctactaaatccggcgaagagacaaccacgccgccatcgtcactgaaggtccctgtatagatggaccaaacactacaaccgcccactatactactacttatctagacaagaggaatcgtaaggccccgtctacggcgacagcgaataccgctaggaagccatgcatatcgcaggtggcataactcgacgacatgcttgcatactatggacttagactaatttttgatagcgatg

SEQ ID NO: 7204 - DNA, 133 bp, Triticum aestivum
  Clone ID: LIB3281-049-P1-K1-C4
tcgcgacccgtgggtgaagacctgacatttttttttacttacccaaaaatgggcctcatggcttttctaggtcaacccgaaaacttttgattctttatgttgtggaggggggatgttgcggatgtaaaagtaa

SEQ ID NO: 7205 - DNA, 421 bp, Triticum aestivum
  Clone ID: LIB3281-049-P1-K1-C5
ccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcat

SEQ ID NO: 7206 - DNA, 424 bp, Triticum aestivum
  Clone ID: LIB3281-049-P1-K1-C7
cccacgcgtgcggccgcctcctcctcctcctctcggctccttctccttccttgcagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtccttcaagtacgcctgggtgcttgacaagctgaaagccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgtgctcatcatcgactccaccact

SEQ ID NO: 7207 - DNA, 378 bp, Triticum aestivum
  unsure (1)...(378): unsure at all n locations
  Clone ID: LIB3281-049-P1-K1-C8
aatcaaacgaaaaaaaaagaagcagttggcggacggactggagatgagcggagccgccggcgagctcaccgcgccgccccgtcgccggcgatccggccgagcagcgcagagagaggagacggcgccgctgctggatcccgccgccgaggctccccagggccgaggtgcagagagaggagggctgttggaccccgctgaggttccccaactccagtgggccgaccccatttccagctcgccgcgtgtgtacggtaggaagcagtggcgtgccgtgtgcaaggtgctcggcaacgacaatctcctcgctgagatcctagtacgcctacctcccaagccgtgctcgctcccccgcgcgtncgccgagtgcaagcgctggcg

SEQ ID NO: 7208 - DNA, 354 bp, Triticum aestivum
  Clone ID: LIB3281-049-P1-K1-C9
cggacgcgtgggcggacgcgtggggtctagcggtataagagacctcacgcttcaacttgttactcggagggactctaaggcatttgtgtgccaaccaggttgcatttgtgctgagccatcaaattgggaaactgaggacctcgtgctaccttgcctcaaagaagtagcaatcaatggcctgagaggaactgaacatgaactcgctcttgtggaaaggttattcaagtgggcgacaatgttagaaagggtgacagtaattttccatgactcaatctctgaaagcaacggcgaagagttccgccagttgttactaagcttctctaggccagcaatatgtatgaaattctcgcatgg

SEQ ID NO: 7209 - DNA, 400 bp, Triticum aestivum
  Clone ID: LIB3281-049-P1-K1-D1
acgcccacgcgtccggcctcggacgcgctaatgacgccgcggtaccccatccacgacacccggccggacgtgccggcgccgggccccgtgttctggtactcggcgtagtagagcgtgtcaagcgcgaaggtgccgtcccacgcgagccagccggcggggtcgacgacgctgtcgagctccgactgaatgaacacggtgcgcgagtactgcttccacggtcggccgaggtaggtcctgaagctggactgcacggcggcgaggtcggaggcggcggccaccttgcacttctggacggagatgccggtgttctggttggggtcggtccggccctgcgccgtgtagatgttgctctggttggggaggggccgacgcgcgttgaggttgcagctctggagcacgg

SEQ ID NO: 7210 - DNA, 420 bp, Triticum aestivum
  Clone ID: LIB3281-049-P1-K1-D10
gaatctaattaaccctttattccaacgatgccctaggaaattcaacaggttacaaaattgcaccataccgcattaagcaagcaattcaggatgcgtccacacgacaacggccatccgttttaacgacataatacatctgaatcatatgacaatgactttcacggttcagctaacaactactacctccgatccataataagggtcgcagttttgaactgaccccagttcaaaaccgtgacacttattttggatcggggggagtagctagtaaccaactgatgctgcgtctgcttaaaactcaaccaggaagaagaatttgtcacgcagaatactacttctctggtggcgaggtcagctgccttaagttgaacttcgaaagctctttgtatctctccaccactccaatcatgcatatagtct

SEQ ID NO: 7211 - DNA, 431 bp, Triticum aestivum
  Clone ID: LIB3281-049-P1-K1-D11
cccacgcgtccgttcattttgtcaatgggaacatctactgttacagatacactttctgtattctacctatcgatggcgtaatgtttgaatattaagtcatttctttttgtcattagcaggtgcttttattcatgttcatattccacgtatgcatgtgctgctccggtggtgttttattagttgattggcatatatggatctctccatgtttattagttgatctccaacccctactctgctgtggtgttgtgggagcaagaagagcatgcatgctttctctctacatctagggtccatacggccagattgacgggcctaaactctgggtttctttcaagaatcatgagagaacattcaaggagtggcttatttggaaattagaaccttcagatttcttagaacttcactcggatttatgtgaatataagcgt

SEQ ID NO: 7212 - DNA, 426 bp, Triticum aestivum
  Clone ID: LIB3281-049-P1-K1-D12
cccacgcgtccgttcattttgtcaatgggaacatctactgttacaggggcactttctgtattctacctatcgatggcgtaatgtttgaatattaagtcatttctttttgtcattagcaggtgcttttattcatgttcatattccacgtatgcatgtgctgctccggtggtgttttattagttgattggcatatatggatctctccatgtttattagttgatctccaacccctactctgctgtggtgttgtgggagcaagaagagcatgcatgctttctctctacatctagggtccatacggccagattgacggacctaaactctgggtttctttcaagaatcatgagagatcatgcaaggagtggcttatgtggaaattagaaccttcagattttttagaacttcactcgcatctatgtgaatata

SEQ ID NO: 7213 - DNA, 342 bp, Triticum aestivum
  Clone ID: LIB3281-049-P1-K1-D2
cccacgcgtccggcctcggacgcgctaatgacgccgcggtaccccatccacgacacgggggtcttacgtgccggggccgggccccgtgttctggtactcggcgtagtagagcgtgtcaagcgcgaaggtgccgtcccacgcgagccagccggcggggtctacgactctgtatagctccaactgaatgaacactgtgcgcgagtacttgttccacggtcggtcgaggtaggttctgaagctggactgtacggtggcgaggttagaagctgcggccacctttcttttattgactgaaatgcctgtgttatggtttggtttcggtccaatccttcaccttttata

SEQ ID NO: 7214 - DNA, 415 bp, Triticum aestivum
  Clone ID: LIB3281-049-P1-K1-D5
acaccatcttcctcaaaacctacaccaaaggcctctgcttcatcaagaagtgcgcaatgtatctcctgtgacagaggatgagatcaggactgttcttcttgcagtggctcctgtcactacacaagatttagtctccagatttaagtctagactacgaggtccagaggacaagaacgcctttgctgaaattctgaagaaaatttcgaaaatacagaagactaatggccacaactatgttgtccttagagaggataagaaatgatgagctcaaaagtggcgatttccttcattgcgaagtatcctcttgtgtcttcctgggggtaaatagtttgtactgtattatattagacgaatttggtcttctgacaagtatatgccgaaattctacccttgcttctactagaaattaaataac

SEQ ID NO: 7215 - DNA, 442 bp, Triticum aestivum
  Clone ID: LIB3281-049-P1-K1-D6
gtcagggatgattttgttggcatggtgcgattcgatctgaatgatgtgccagtacgtgtgccccctgacagtccactggctccagaatggtaccggcttgttcataaggatggggacaagtcaaggggtgagctgatgctggcggtttggattggcacccaagctgacgaggcatttcctgatgcatggcattcagatgctgctacacttgaggatccatctgctgtaacacacatgaagtcgaaagtttaccatgcacccagactgtggtacctgcgagttaatataattgaggcccaagatattctcatacatgataagacccgctatccagatgtttttgtcagagcacaggtggggcatcagcatgggaggacaaaacctgttcaggctagaaacttcaacccattttggaatgaagaccttatgtttgtggctgctg

SEQ ID NO: 7216 - DNA, 295 bp, Triticum aestivum
  Clone ID: LIB3281-049-P1-K1-D7
cccacgcgtccgccctctcctccttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaagagggcggcaaggcgaagaagaaagccaagaagagcgtggagacgtacaagatctacatctttaaagtgctgaag

SEQ ID NO: 7217 - DNA, 436 bp, Triticum aestivum
  Clone ID: LIB3281-049-P1-K1-D8
ccgacagccgggaaaccaaagatggccctatagttaataaaagcagctgcaatttacttgcacctgctgtaacccgatacttcgcctctgatttgatcgtctcgaggaggtcacttgaaggcaaaggtagagctgtgaaagataaatgcactcctttgcttccagatccaccaagcggtgagctggatgaaggagcaagtcccatgcctcggcctggacggggcgatccgatcacagccttacaccaggcggcgaacacagcactggcctcctcgggggggttgatccaaggcagtgcctcatcctgtaatggcggaaaagttacaaatatttcttgcatctgcagtttctatcctaacttcctgtttttttggtggtgaacatgatgagttgagatgtcaaaatgtgtatcacttgtcagcatacgtttttaata

SEQ ID NO: 7218 - DNA, 379 bp, Triticum aestivum
  unsure (1)...(379): unsure at all n locations
  Clone ID: LIB3281-049-P1-K1-D9
cctttccccacccgacgcaccctcgccgtcaagtctagggtttagcggagcctgcagccgtctcccgagccgcccatggacgtcgactccgaaccgtccgccgagagcaagcccacccagatggacctcgaggaccaggcggacgcgaaggggaaggggaaggccgatgccgcggaggaggagaaaggaaatggaaaggggaagggcgacgaactcgcggactccatcgggagtctatctatcggcccggggcgcgccaacttcaagaagaagccggtgatcatcctcgtcattggcatggccgggacggngaagaccaccttcatgcaccgtctggtgtgtcatatgcangcatcggcgaacatgaggggttatgtgc

SEQ ID NO: 7219 - DNA, 381 bp, Triticum aestivum
  Clone ID: LIB3281-049-P1-K1-E1
cccacgcgtccgcccacgcgtccgcggacgcgtggggtgaagtcagagccagaggaaggagaggtgctgatgatgatgcaggacggaggcgaaggaggcggcgcgtcggtggcggcggagtccatggcgccggcgcagatcgacgtgaggatggacctgacgctgctccactgccagggctgcctcctccccctgaagccccccgtcttcaagtgcgaggccgccgggcacgtcgtgtgctaccactgccgcgccgtccacagcaccatctgcagccgcgccagcacgcactgcggcgagctggacgccgtggtgggcgccgccaaggtgccgtgcgcctacagggcgttcggctgcgagcggcacgtggtgtaccacgag

SEQ ID NO: 7220 - DNA, 437 bp, Triticum aestivum
  Clone ID: LIB3281-049-P1-K1-E10
cggacgcgtgggctccccaaggagatgttcaccagggccgactcgggcgccgtcgtcgcggcggccctggcgcccccgccggccgccttgaactcgatgccggcggagccgcccgagagcgcgcggacgccgacgacgaagctgttctcgccgcccgcgctgcgcggcggggccaggaacgacactgcggtttcgccgccgtcgtcgtcgacggcaaaggcaacagcaattgggcggtggtgtatagaattgttgtatgtactaccagtactgctgcctctggtatgagatccggtgtatattactaggagtaaacctgtacacaatgggtttgaaaaggtggggagaaggtagatgactcgaggtgaagaagattgagctgcaaagcaaagcagcgttcttttcactgcctgcatcatgctgaaaaaggagaaatg

SEQ ID NO: 7221 - DNA, 368 bp, Triticum aestivum
  Clone ID: LIB3281-049-P1-K1-E11
cggacaggtgcgcttctgacttacatagggacgattggattctaagaggccatattcttgtgctgcttgtgctagctagctaggggctaccaattttcagccagggacttgtaaaccagtgctctgcaggaggtaccagatcccatggccggcaaggaaatctaccacaagatgaaagacatggtgaaagatgctcttacatcatcatgaccagaaacagggaaaggcaagacaaaattgttatgcaggcgtgtcaagcatggttaccatcttgtgaagggggaatcaaatcattcaatggtggactacttgttggcggaatatagtcaagttgaggagcatgattttggtttgtttgcaatttttga

SEQ ID NO: 7222 - DNA, 440 bp, Triticum aestivum
  Clone ID: LIB3281-049-P1-K1-E12
gggagaggtgcgattctgacttcccgaggggcggctggattccaagaaaccatattcttgtgctgctagtgctagctagctaggggcgaccgagtttcagccagggacttgtaaaccggtggtctcgaggaggtacccgatcccatggccggcaaggaaatctaccacaagatgaaggacaaggtgaaagatgcttttagttcatcagggccagaaacagggaaaggcaagacaaaattgtcaggcaggcgtgtcaagcatggttaccatcttgtgaaggggaaatcaaatcatccaatggaggactacttggtggcggagtataggcaagttggggagcatgatttgggtttgtttgcaatatttgatggccacctgggccacactgttccagactttctgcgtgcacatctctttgataacatcttgagcgagccaga

SEQ ID NO: 7223 - DNA, 436 bp, Triticum aestivum
  Clone ID: LIB3281-049-P1-K1-E2
cccacgcgtccgggagttctcttaagaaagaaattttgatgaaaagtttactgtgtacatagtacatactaaatttcctatctgaagagtttctccaggtatgtaccaatcatcatactagtgaatgcttctattttgtagatgtcaatatgagtgctgaccaacatagtttcattttattaaatttcatacggcctatgaacatttttttgttataattagagccagttattgtgatttgtggatgtaaaaatgtttgtccccccattaacttagtttcaattcttgggcacatgcttggaagatgtgaaggtctcgtaatgatttggatgtaacacaacacccatgtaatgtgagcaatggctgagagatgtgaaccaaccgccacgcaagtggagggatgaattgtggggctggcttggttgtaaaaatatac

SEQ ID NO: 7224 - DNA, 417 bp, Triticum aestivum
  Clone ID: LIB3281-049-P1-K1-E3
cccacgcgtgcgcggacgcgtgggctatgggttgaaagcaactgtccagattgtggatctgcaagtctttgcatcgcctcgtattactctgaagccgttggtgcctacatttccttgcttcgctaatatcagtgtttctctcatggagaagccacatgttgatttcgggctcaaactattcggagcagatttaatggctattcctgttctttacaaattcgttcaggacaccattaagaagcaagttgggaacatgtatctgtggccaaagacactagaagtccctataatggatccctcaaaagcatcaaagaggcctgttggaattctacttgtgaaggttgtaagagctcaaaatctgaaaaagaaggatctgctgggtaaatcagatccatacgcgaaacttaagatgacaga

SEQ ID NO: 7225 - DNA, 431 bp, Triticum aestivum
  Clone ID: LIB3281-049-P1-K1-E4
gctgctcataaggaagcttcctttccagaggcttgttagggagattgcccaggacttcaagactgacctccgcttccagagccatgcggtgctggcccttcaggaggctgcagaggcctacttggtgggtctcttcgaggacaccaacctgtgcgccatccatgccaagcgcgtgaccatcatgcccaaggacattcagctggctaggaggatccgtggcgagagggcttaaggtgcttgctttgcctgtgggaatggctctggtgggcatctgcgtctgcttttgctgctgaacacttgtcatgtgtcgtgaactactaatactggtcgtgtgtagtaatatgtcagtagcgtactctgtgcaatactatgttcgtggagctggatcatttgttcgttggtcgtcctaaatcatccacctggttggtgcc

SEQ ID NO: 7226 - DNA, 383 bp, Triticum aestivum
  Clone ID: LIB3281-049-P1-K1-E5
cggacgcgtgcgttgtctcttagctgctttcaatacatcattctcataattaggtgatcaaatccaggattaactccatgaagctctcaacggagcatacacgtgcgcatgctccatcaagcgtgccttcaattgagcagacattcacatgcgcctacacatggtggcaaccttggctgaaactattgcgcacattttcgggctcattttgaggatggttacgacagtggtcacctcagcaaaattcgatactgatctggatactgtattggttagacactttggaagacacatgggtggctataaggttgtctccattgaagagtctattcatgacacataaatgcccacatacctgcgctcagtcctcacttaacatggca

SEQ ID NO: 7227 - DNA, 441 bp, Triticum aestivum
  Clone ID: LIB3281-049-P1-K1-E6
cccacgcgtccggattgctgttgcgcccgtttgtagtatattttttcatcaacttctgcttgactcttctagtatcaatggaaagctggtatcaccattatcaatttcatcttgcagaccgctatatagctctgttctaagcgtcccttgatgcatcctgtaccaattcagcctccattgctcaatgcatgttgctgcatctacgatgaactgaaggaacaattttccacttgtttgcaagactactgactagttcagtcgctgctgtatgcgatatgcataatactccatcatggtaacatactttctctttccttcgacaccttttgttttttctaatttaatttctggtctgaatccatcttctccgtatgggaataacaacgggtattgcataaacataaagcttggatgcagttccgaaattcgctggagttgttt

SEQ ID NO: 7228 - DNA, 280 bp, Triticum aestivum
  Clone ID: LIB3281-049-P1-K1-E7
ctcctaccgacgtcgccgtagtcgacgtctgactagagccgccgtcggcatggggagaagacctgcgaggcgctatcggcagatcaagaacaagccgtaccccatgtcaaggtactgccgtggtgtgcctgaccctaagatcacagatctatgatgtttgcatgaagaagaagggtgtagacgagttctctcactgagttcaccttgtctaatgggagaaggagaatgtgttcagtgaggctctagaggctgcccgtatcgcttgcactaagtacatgac

SEQ ID NO: 7229 - DNA, 367 bp, Triticum aestivum
  Clone ID: LIB3281-049-P1-K1-E8
aaaatggctggtgttgctaggaaagggaggtccaagtgggacacacaggaaagttctcctgatattgttgagatcagtgaagatgactctcctcctaagaatacagatgatcgccgcaaagatgtgatccctactcaggatctcactaatgataatggaaagcgacttggtgaatcttctaacctaaaacctgatgccttcatgcaccaaggcagtactgaatacgagcaggaacgcactgatgggttaaataaagatgtcaaggaaaggcaatctaaagcgtcatctgaaaggtcgcatgctcctagaatggctgaagaggggcataaaaaatgatgactggggtaaagttagcttctttgggaaa

SEQ ID NO: 7230 - DNA, 372 bp, Triticum aestivum
  unsure (1)...(372): unsure at all n locations
  Clone ID: LIB3281-049-P1-K1-E9
agcaatccccgccaatcgccatggacgcgctcgtcgccggacagcaggccaggcggcggatccggccgccggagcccctcgtgatggccgcctccccgaccacgcccgccgcgttcaagtgcccgatctcgctcgaggtgatgcgctcgccggtgagcctccccaccggcgccacctacgaccgggcgtccatacagcgctggctcgactccggccaccgcacctgcccggccacgcggctgccgctcgcgtccaccgacctggtgcccaacctgctccttcgccgccttatccacctgcacgccgncacgctgcccccctcgccctcgcccgaggaggcgctctcgcagctcgccgnctcgcacggggagc

SEQ ID NO: 7231 - DNA, 441 bp, Triticum aestivum
  Clone ID: LIB3281-049-P1-K1-F1
ggcgcacgcgatcgatcgcgacgggagtgccgatcgcgccgccggaggttcgagggcggttggttggagccggcggaggaggcgatggggcggctcttcctgatgcacctcgaggggaacgcctacagctgcaagttctgccgcacccacctcggcctcgccgccgacatcatctccaagaacttccattccaagcacggcaaggcgtatctcttcaacagggttgtcaatgttacatctggtataaacgaggatcgcatgatgatgacagggctgcatactgtttccgatatcttctgtgttggttgtggatccattgttggatggaaatatgaggctgcacatgagaagagccagaggtacaaggaaggaaagtttattctggagaggtttaaggtgtcgggccctgatggtagccactactggggggtgacacatgat

SEQ ID NO: 7232 - DNA, 441 bp, Triticum aestivum
  Clone ID: LIB3281-049-P1-K1-F10
gtggatctactgccgccgccggcgtccttgaaggtctcctgcctcaccgcgacctacatgagctgcgcatcacgagataccctggagcgacgtcgccgagctggctgggcttgcagatggagaagctgacgagcctgtacatcaggaactgcaggaagctaaacgccctgcctgcccttggtgagctcccctgcctggagcttttggatgttaaggagctcccctgcgttaaaaggattgacggcggcttctgcggcgccggcgcgttcccaaagctgaagaaggtcgtgctcgacgacatgccgggtctgctggcgtggggtgacatgccgaaactggcgttccctctgctcacggaggtgagcatcgccgactgcccgctcctgtcctccttgtcgggcctcgagcgcacaggtcccctcggcctgcgagtgatgggat

SEQ ID NO: 7233 - DNA, 436 bp, Triticum aestivum
  Clone ID: LIB3281-049-P1-K1-F11
cccacgcgtccgcccacgcgtccggaattctggtggtgaagaaagagggaaacggaaggttatataagtcgtcgtggatcacagttggctttaaagcatctttgtgagaaatttggatcatcattattcgaaaaactccccaagttgtgggattgccttaccgagtttcttgaacctattaagatcgaagatgacattcacaaagatgatccaagtataacacatctaggcagatcttgtgaggataaggacccacagtccctcataaataacatccaggttgtgcgttcaattacaccttacctgcctgagcccttgaggcctcagctggtaaggctccttccctgtatttttgggtgcgcgcgtcattctcatgtggctgttaggttagctgctgccaggtgtatcacgtaaatggctaaatcactggctggta

SEQ ID NO: 7234 - DNA, 358 bp, Triticum aestivum
  Clone ID: LIB3281-049-P1-K1-F2
acgcgttcgcccactcgtacgcccactcttacggccagcaagcgctacatcaagctggagggtttcaccaaggtccttaagaccatcgagaagcacggcctcgaccgctaccaatcataatactagtgaatgcttctattttgtagatgtcaatatgagtgcttaccaacatagtttcattttattaaatttcatacagcctatgaacatcttttcgatataattagagccagttattgtgattagtggatgtaaaaatgtttgtccccccattaacttagtttcaattcttgggcacatgcttggaagatgtgaaggtctcttaatgattttgttgtaacacaacacccatgttatg

SEQ ID NO: 7235 - DNA, 418 bp, Triticum aestivum
  Clone ID: LIB3281-049-P1-K1-F3
cggacgcgtgggcggacgcgtgggggagaaggacgaggaacaggataaggatgggttctttaagaggttgcttagagacagcaaggacaaggaggaggatgatggagacaaggaaggttttattaaaaggttgcttaaggatagcaaggagaaagagaatgatgaggaaaaaggggataaagatggtctcttccgtaagttgcttaaggaccacaaggaccaagattttgaacttacacctaacttggatgggttggttaaaaaactttttcctgacaaaaaagacagaccgggccaccattaccagaaaggagggttttttcgcaagatattcaagggttagaatgaggagaggagagaaagcatgcatggaaggcttggggatgaggaaagagtatgtaagagtttggaggatgat

SEQ ID NO: 7236 - DNA, 439 bp, Triticum aestivum
  Clone ID: LIB3281-049-P1-K1-F4
gcgatcgtgtaaatatacgctctcactccacttcctccgatccaagctccacccatggcgctctccatttccgcacccacctcgtctcccttcctccccgccccccgccaggtcggcaggtggagctcgtcaccaagctcggctaagcccgcggtttttagcctacggaggccggttgtggtggcacgggccgccgccggcaacgcgccctcttcccccgcaggcgcggtcgtaactgagttcgacgtggtctccagcttcagcgagatcgtgccggacacagtcgtgttcgatgattttgagaagtttgcaccgacggcggccaccgtgagctcttcactgttgcttgggatcgcagggctcccggataccaagttcaagagtgccatagataccgcattggtagatggtgaatgtaacacaatggagaagcccgggg

SEQ ID NO: 7237 - DNA, 391 bp, Triticum aestivum
  Clone ID: LIB3281-049-P1-K1-F5
aagataaaatgctacaggtacattggaccaaaccaagtctgtttctctaaatcaaaaaaggaacaaaaagaattgagctaaaagttaaaatcaggcctggagcttcacatgccgatcagcctaccatcggctgcaaagctaaattagaacatcacatttccccatggacataatttacaagcctttttacatcttaagttacagaagccaagggagtataaatccaagtagctctcaaaacattaacaacccattttagtgcctagtgttcatgcttgacacgccctttcagtatccctggaataggaggtgaggttcgtagcctaattccatttggccttgcaggttgtggtgatcgacgcccataaacatttgatgcacttgagcattc

SEQ ID NO: 7238 - DNA, 388 bp, Triticum aestivum
  Clone ID: LIB3281-049-P1-K1-F6
ggaggttgatcgtgtaacagaagctggaggtgatgttggaaggctaaatgttgttggtggtgctgagattggcccccttagatgctggcctgggggtttgtgcctgtcaaggacaatcggagatcaggacgtgggtgaatttatcgttcctgttcctctcgtcaagcaagtaaagttatctactgctggaggccggcttattatttcaagcgatggtgtttgggatgctttgactgcagaacaggctctgaactgttcaagaggactttctcctgaagctgcagccgagcaaattgttaaagacgcagtgcactcaaagggactgagggatgacaccacttgtatagtcgttgacctagtaccagaaaaaggcaacccagctatgtca

SEQ ID NO: 7239 - DNA, 330 bp, Triticum aestivum
  Clone ID: LIB3281-049-P1-K1-F7
cccacgcgtccgcccacgcgtccggccggcaagcgctacgtcaagctcaggctctccaccaaggccctcaagaccatcgagaagcacggcctcgacgccgtcgccaagaaggcggggatcgacctcaacaagaaatgaaatgatcgatgagccatagttaaggtctcctagcaacaacatcttcttgatttcctcacatcaaccatttcaatgtaatgtaatgtaatgtagtatgcaaaatggatttatgttcagctttccttttctccccttttcttgatttgctattttccttgatgagttatataatgttaagcatcatactggatc

SEQ ID NO: 7240 - DNA, 439 bp, Triticum aestivum
  Clone ID: LIB3281-049-P1-K1-F8
cggacgcgtgggctcctcccttcttcagccgaagcgcccgcacgcctcgacccaagggatcccaatggcgccgacctccaagatggcgctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgttagcacccgcaagcctaagcccaccaagctcaggtcgaccatcacacccggcacggtgctgatcctgctcgctgggaggtacatggggaagcgcgtggtgttcctgaagcagctcaagtctggcctgctcctcatctctggacctttcaagatcaatggcgtgccagttcgccgggtgaaccaggcttatgtg

SEQ ID NO: 7241 - DNA, 421 bp, Triticum aestivum
  Clone ID: LIB3281-049-P1-K1-F9
ggctttagcgtcaacgccgacgccccccttcccacacacagacccctgcgcccgccgccgccaccggcggcgtcgccgtcccacctcgtcgcctccgccccgttcgcaacccccgacatctgctcctgaggtgaactgagcacccaacttttgtcaagatgtctgatagtcatgaaaccgacaagaatattgagatgtggaagatcaagaagctgatcaagggactcgagtctgctagaggcaatggcacaagcatgatctctctgattatgcctccacgtgatcaagtctcgcgtgtgacaaagatgttgggtgatgaatatgggactgcttcaaacataaagagtagagtcaatcgtcaatctgttttggagccatcacctcagctcagcagaggctgaagctgtattacagggttccc

SEQ ID NO: 7242 - DNA, 441 bp, Triticum aestivum
  Clone ID: LIB3281-049-P1-K1-G1
gttcatcaagttcatcgagggcagccgatacgtccccgtgaggcccgccccctgtgggttcatcctcctccgagacacgcagcccagcgaagcggaggagctcgtgctcaccgacgcccccgcgaccgtggccacgggcaccggcaacaacgcagcagccgctgccgcggggcaaggctcggccgccatggccgtcgacgacgagccacagccgccccaacctttcgagtactcggcgtaggctcctgtgataggatggagcgttgtctgtactcacccactagctatacgttgttgcttattcctttttcaagagtgcgagggaatttgttgtttgttggaaactgtgtagaatcatcatgagtagagaactcagactctgaacgggagttacaggatatgtgctcagccatgtttgcatcaaggaagaacgattgattt

SEQ ID NO: 7243 - DNA, 381 bp, Triticum aestivum
  unsure (1)...(381): unsure at all n locations
  Clone ID: LIB3281-049-P1-K1-G10
cggacgcgtgggcggaccgtgggaccacgagccacttcctcccctccaactccaacaccaacaccaagctcgcgctggctcccgacggtcactgttcaccttttccccgtaacaggaacaagtagatctcagggggaagagagagaagagcgtcctctgtcattacttcactttcactcaagaagaaagaaacatcgcgagattggtagaagcaagacgcaggcggaggaggaattcatagtagatgcgtgcgcgtcgatgaggattcgggggctggcgatgagcggcggcagggaggtggccatctccgccgtcttcacggcgctcctcgtcgtctacatcctctntctcccctcggtcctgctcaccagcggcaggctc

SEQ ID NO: 7244 - DNA, 435 bp, Triticum aestivum
  Clone ID: LIB3281-049-P1-K1-G11
ctctcacctccggcgaataacacaccagagctcacctctcccctcgcttccccgcgaaaatgtcgactgacgtggctgccgctgacatcccggtgcctcaggtggaggtagccgccgacgctgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcaccttccggccaacttccgcaagatcctgctgacccagatcaagaagctcgtcgccgccggcaagctgaccaaggtcaagggctcctacaagctcgccaaggcccccg

SEQ ID NO: 7245 - DNA, 346 bp, Triticum aestivum
  Clone ID: LIB3281-049-P1-K1-G12
cggacgcgtgggcggactcgtgggggaaaaagggcggacacgccaggaaagaagaacgagaaaggagtccaagaaacgaccagaccaggaggaaccaaatccctggaccctccctcgagaccttgagttgataaacaatccattttttcaagagctgggctgcagtccgcacgcacgcagggggacagtgcggagatgaagagccgaggtggtccgcggtccccatcctacggattaggacgggatccggccgcgccgccctggacatggacatcatctacagcatcaagtgcgtgtcgacgtccaacggggtcgaggacgacgaccccatgtactccaacctgcc

SEQ ID NO: 7246 - DNA, 439 bp, Triticum aestivum
  Clone ID: LIB3281-049-P1-K1-G2
cggacgcgtgggggtctgtaccctcacttaaacactctcgcctacccgggctcgacccccctcctcccttcttctccctcgccaagaacaccgccgcagccaccgcgatcgatctgtttctctgtctcccgtgcgcgtctggagcggcggctggggtgggcgccatgatcctatgaaggagaaggagaaggagaaggagaaggagaaggaggaggaggaggagaggggatagataggtggctgcgtgacaaaggggccggatcgatgtacacgaaccagctgcaggagctggcgcagaggagctgcttcagcctgccgtcgtacgtgtgcacgcgggaggggcccgaccatgcgccccgcttcaaggccaccgtcaccttcaacggcgagaccttgcacgggcccacctgctgcaccacgctccgccaggccgagcacg

SEQ ID NO: 7247 - DNA, 445 bp, Triticum aestivum
  Clone ID: LIB3281-049-P1-K1-G3
cccacgcgtccgcccgttctttagtggggtctctttcgaaacctgagagatcgcagcaacataagtcttcatcaagtgattctagtaccactggaaatttcactaacgccgaacaaaacagtctgaatactgatggccaaatggattcccaggatttttttgggggctgtgatactgttgatataacagggactagtgtattagaagtggagaacgccagattaaaagcagaactcgcttctgcaattgcagttctctgcacttttggtgctgaatacgcacatgaatctattgatgaagggcagaatgatgatgtgttgagaaatgcaagagagaaaacatctcaggcactttccgcgaaggatgaatatgccaaccagcttcagtcagtgttgaaagcaaagcaggagcagtgcttgtcctttgaaaagcgtatacaggagct

SEQ ID NO: 7248 - DNA, 435 bp, Triticum aestivum
  Clone ID: LIB3281-049-P1-K1-G4
gggctagttcctactggagatcagttaaggttggttgggatgaatcaactgctggggaaaggccgcctagagtttctttatgggagattgaaccattgacaacctttcctatgtatccgtctttgtttccgctgagggttaaacatccctggtattctggtgtagcaggccttcaagatgacagcaatgctttgatgtggctgagaggagttgctggagatggaggttatcagtctatgaactttcagtcacctggtattggctcctggggacaacagaggctccatccttctttgatgagtaccgaccatgatcagtaccaagcagtagttgctgctgctgccgccgcctcccagtctggtggttacatgaaacaacaattcctaaaccttcagcagcctatgcagtcacctcaagaacactgtaacctcaacc

SEQ ID NO: 7249 - DNA, 432 bp, Triticum aestivum
  Clone ID: LIB3281-049-P1-K1-G5
cccacgcgttcggccggcggccgagagcaaggtggaggaggcggccgagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacgtcccgggagatccagacctccgtccgcctcgtcctccccggggagctcgccaagcacgccgtcttcgagggcaccaaggccgtcac

SEQ ID NO: 7250 - DNA, 243 bp, Triticum aestivum
  Clone ID: LIB3281-049-P1-K1-G6
cggactctctgccgacccctcctcctttaagtttgaaaccatacacctgcgctgggggagctagattacgcgattccaactcaacttccgcaccttcttgactcgcaatcgacatcctacagcctgtacatccacactcacgaggctatacacctgccaaccatcagaacttcctgccacgatctattataagctacgcctccctgcctttacccttgacctggttttcctgacctctgattc

SEQ ID NO: 7251 - DNA, 429 bp, Triticum aestivum
  Clone ID: LIB3281-049-P1-K1-G7
cccacgcgtccgcggacgcgtggggcccagtagagttgtatggatacatagcagtgcgggattatctggatacattgcgtaattatgttgtcaatataagcagggatgatcccatcattgtgaagcagggttctctcatcgacatggctggccctaagcgagggatagatttgatttccagtattctagtggaatatgacatgaggatcaaggtaggtgaggaagaaagggatgattaccagctgattgatggtgtaacagacatagacgacctgggcccatggaatcgtgcattgaaaaatcgcatccaaggcgactgtggtgcggttgacttaaccatagcacgtgttgatgacgcagtcatggcgaatattgaagttgccgtgtcagaagtgcagagcagttttcatctgcgcttgcgctgtttta

SEQ ID NO: 7252 - DNA, 429 bp, Triticum aestivum
  Clone ID: LIB3281-049-P1-K1-G8
cggacgcgtgggcggacgcgtggggaaacctctactgcaagagaggacaagaaagaaggtccatgttttgagtggtcgtgggaaagatgagctcctaaagattatggaccatttgtccatcccccatttctgtcgacgcgagggttcatcaaaagcttcgttgagcagcgtcgatgactgcttctcgctcgaccaccctttccaccaagagctctatcattacatcgagcagcaggcgttgaaccaggagctcatcaagcagggttctttgcatgtagacatccccgaccaagaccccgatgatgccatgattgtggaggtcatccaagccgagtttcacaagctcggtgaacagaatgggtctgctgatggcgaccataaataaacgtgttcgtgtaagatgtcagcggcttgcacaatagatgtgtg

SEQ ID NO: 7253 - DNA, 440 bp, Triticum aestivum
  Clone ID: LIB3281-049-P1-K1-G9
cggacgcgtgggcggacgcgtgggggcaaaaatgtgggaagatatgcacatgcatcatgcaaatcagctgaaaactgtgttggatctcaagtcagttgacatttctgattccagcatcgaaacaagtgcgcatcaccacagccacacgcgtcagctgcatgatattgtagacaagtggaacacaaactttagtgatctcatgagctatcagaaggagtacataaatgctctctacagctggttgaaattgaaccttatacctatagagagcagcttaaaggagaaagtagcatcgccaccaagggtgcagcaacctcctgtgaaggctctcctccaagcatggaatgagcaactagccaagctgccggatgatcttgccaggcatgccatcgttagttttcgggcggtcctggaaaccatactaggtgttcaagacgagg

SEQ ID NO: 7254 - DNA, 426 bp, Triticum aestivum
  Clone ID: LIB3281-049-P1-K1-H1
atcccgcagagcacgctccctccgcccctcgtttccccacccaccagcctagggttccggcgagatgaagcagcaggatggagctagcccggccaagatgttcatcggcgggctctccaggcagacaagcatgggtacgttcaaagagtacttcgggaagtacggggagataatcgatgcggtaataatgaaggaccgccatacccaaaagcctagaggctttggatttattacctattcagatcctgctattgttgacagagtgattgaagataaccatgtcattgatggcaagcaggtacactccgtggttcctattactgctggaattatatcagttcacatgggagttcatcgcttttccttgcattttttagtacacaagtcacatgttatgaagtttaagatccttgactatgccacaac

SEQ ID NO: 7255 - DNA, 406 bp, Triticum aestivum
  Clone ID: LIB3281-049-P1-K1-H10
ctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctcttgaggctgcccgtattgcttgcaacaagtacatgaccaagcatgcaggaaaggatgccttccacctcaaggtcagggttcacccgttccatgtgctccgtatcaacaagatgctttcgtgcgccggggctgataggctccagactggtatgaggggtgcttttggg

SEQ ID NO: 7256 - DNA, 440 bp, Triticum aestivum
  Clone ID: LIB3281-049-P1-K1-H12
cggacgcgtggggctcctcgctactccacggccatggccaccgccgtcgccgccttccgctctttcattcaccccaccgccattgccgccgccatcccactccctccttctcacttcaacctcaacaacttccagcggcactgcgtcgggctccgcctattctcctcctcccaccgtcgccaccccattctcctgcccgcctgcacctccgttgcttccggccaagagttctcttctgacggagaatattactctgaggagggtccagaggagtacgtggaggaagagggagaggaggcagaacccgaggttcaggcaggtcgcggttactatcccccgagaaaccggccggcacttggacaagagcccgggcgaatctacgtcggcaacctgccctacaccttcaccggcggtgagctcactgcaggattctccgagcc

SEQ ID NO: 7257 - DNA, 404 bp, Triticum aestivum
  Clone ID: LIB3281-049-P1-K1-H2
cacagacaaagcctcctcgctccaatcttgtctgcatcgagagcgcgagatccagagttccaaaccaaaccagccagcagcagagctagacgaaccggagcggcatggcaggcggcgacgagggctccctggtgccgcgggaggtgccgggcagctacggcatgccgttcgtctcggccatccgcgaccgcctcgacttctactacttccagggccaggacaagtacttcgagtcccgcgtcgacaagtacggctccaccgtcgtccgcatcaacgtcccgccgggcccgttcatggcgcgcgacccgcgcgtggtcgccgtgctcgacgccaagagcttccccgtgctcttcgacgtcgacaaggtcgagaagaagaacctcttcaccggcacctacatgccc

SEQ ID NO: 7258 - DNA, 426 bp, Triticum aestivum
  Clone ID: LIB3281-049-P1-K1-H3
ggcattgagatccgtattgccaggattttcaacacctacggacctaggatgaacattgatgatggccgtgttgttagtaacttcattgctcaggccattcgtggtgaagcactgactgtccagaagcctggaacacagactaggagcttctgctacgtcgctgatatggtcaatggtcttatgaagctgatgaatggagacaacaccggacccattaacattgggaacccaggtgaattcaccatgctggaacttgccgagaatgtgaaggagttgatcaacccagaagtgacagtgacgatgactgagaacactcctgatgaccctcgccagaggaagcctgacatcaccaaggccaaggaggttctcgactgggagcccaaggtcgtcctgcgcgacggcttggtgctcatggaggacgatttc

SEQ ID NO: 7259 - DNA, 445 bp, Triticum aestivum
  Clone ID: LIB3281-049-P1-K1-H4
gccgccgctcgcagcttcctcctgcgcgagctcctctcgcgcccgcaagacgcctcggcggcgaccccacaccttcgccacgccccgccgccggcgaccttccccggtggatctccgacctccatggtgtcgttggccttcaatctcgctggatccggccgcctccatgccaaatccaccggaaatggatccaccccggccagatctgcccggatccaaccgggccccgccgtcgtcgccaccggagcgccgccccgaaattttgggtcaaactgctcttcaatccttgctgatttgtggttttgagacccacccaagcagggctgcgctcaggagaagaacctgctgttcctggaggcctgacagacagccgatcccgctattatcacaagtccgctttgtgacgagctggtcaacacgcgggaggagacatatatgattccac

SEQ ID NO: 7260 - DNA, 437 bp, Triticum aestivum
  Clone ID: LIB3281-049-P1-K1-H5
cggacgcgtggggtgctgacggacccgcccacgcctgcaggcctcgccctggagcaggcgacgtggcgtctggtggagcgggacgcgatgacggccgtcatggtcgaggagcaggagcggcccaagaagaagggcggcttcttctcgttcttcggcgggtgaagcctgagctgaaccgagccgccggtgacgtgcgtggtgtgtatagagctgcgatttggagctgcttagtcgtttttcggtttgttttgctcttgtttttcctagcgtagcacgattcattcggtgtgcttgattccacagagacagacggtcttttctttgttcttccaaatttacgccgaacattagcagagtaaatgtatgtagttttgtggttgattgcttcttgctgttgcagtgagctcatcttgttggagtggtgttgttcatggctt

SEQ ID NO: 7261 - DNA, 443 bp, Triticum aestivum
  Clone ID: LIB3281-049-P1-K1-H6
gcgtcgtcgatgctgacgcagtacgacatcgaggaggtgcaggagcactgcagctacctattctcgcagcaggagatcgtgtcgctgtacgagcgattttgccagctcgaccgcagcgccaagggcttcgtcgccgaggacgagttcctctccatcccggagtactccaccaacccgctctcccagaggttgctacgtatggttgatggattgaacttcaaggaatttgtttcttttctctctaccttcagcgcaagggccagccttcagcaaaagattgagtttatatttaaggtgtatgacattgatggcaaggggaaagtaagcttcaaggacctggtggaggttttacgggacctaacgggctcatccatgtcagagcaacaaagagagcaagtactaacaaaggtgttggaagaagctgggtacacacgggatttcac

SEQ ID NO: 7262 - DNA, 283 bp, Triticum aestivum
  Clone ID: LIB3281-049-P1-K1-H7
cacttatactgggaggcatccatgccattttcattccccaacaaattgatttacatgtaaacaatcatcatcatcatcatcaacatcatagccctgtcatcaacaccatctaattcattttactaaaccaaaaaccagaacgaagaacaaaaatgaagtgataggcagagtcgcttgtactccatctccatctgtccaagaaaaaaggaagccaccgaccgaaaacaaccaatccataacttgttgtgagtgatcagtctaattgacaactaccaagtcatca

SEQ ID NO: 7263 - DNA, 238 bp, Triticum aestivum
  Clone ID: LIB3281-049-P1-K1-H8
ctgacgcgtgggcggacgcgtgcggccaaaaatatttgtagatatgcggatgcgtgatgcatatcagttgtgaactgtgttggatcaaacggaagttcgacgtttgcgattaccgtatacaatcaagtgctcataaccatagcgacacgcgtcagctatatgattttttaaaccagtggcaaacacactgaagtgatctgatgtgatgtgaagagcgagttcatacatgctctgtata

SEQ ID NO: 7264 - DNA, 440 bp, Triticum aestivum
  unsure (1)...(440): unsure at all n locations
  Clone ID: LIB3281-049-P1-K1-H9
cggacgcgtgggcccgaccgccgccgccgccgccgcctcctcctctcggttccctctccttccttcgagagcttcagccatgggtaaggagaagactcacatcaacatcgtggtcattggccacgtcgactctggcaagtcgacgaccactggccacctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctggtcaccgtgacttcatcaagaacatgatcacccgtacctnccaggctgactgtgctgttctcatcatcgactccaccactg

SEQ ID NO: 7265 - DNA, 252 bp, Triticum aestivum
  unsure (1)...(252): unsure at all n locations
  Clone ID: LIB3281-050-P1-K1-A10
ccgggccggaagggcgggggcgacccacgcggccgagacgngacaggcaaaagagagaaaaaaaccagccaggggggaggagaacaanagcagggggagagaggcgaanccaccgggagaaagcagggggggcacaggagagaccaagaaaaagagcgagagcaggaagaagagaaggcnccaagacagacgaagcccagaaggaacaggaggaggaagcngaaggacaaggaggcggcgcacaggagcaag

SEQ ID NO: 7266 - DNA, 370 bp, Triticum aestivum
  Clone ID: LIB3281-050-P1-K1-A11
cccacgcgtccgcccacgcgtccgcaccatcaccaaaggtctctgcccctctccagctcttcttcaaaagcgccgtcgttagcaatggaggcctcaggcgctgcagcgaaggggaagaagggcgcggccggtcgcaaggccggcggccccaggaagaagtcggtgacgcggtccgtcaaggccgggctccagttccccgtcggccgcatcgggcgctacctcaagaagggccgctacgcccagcgcgtcggcaccggcgcccccgtctacctcggcggcgttctattgtacctcgccgcccagctgctggagctcgccgggaacgccgtccaggacaacaagaatagccgtatcttcccgcgccacctgc

SEQ ID NO: 7267 - DNA, 353 bp, Triticum aestivum
  Clone ID: LIB3281-050-P1-K1-A12
cagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgg

SEQ ID NO: 7268 - DNA, 380 bp, Triticum aestivum
  Clone ID: LIB3281-050-P1-K1-A2
cggacgcgtgggcggacgcgtgggaggggctcctgcactccgaccaggaggtcttcaacggcggggccaccgaccccctggtccagtactatgtcagcagccagagcgctttcttcgcagacttcgtggcaggcatgatcaagatgggagatatctcgccgctcacaaggaacaatggagagatcaggaagaactgtaggaagagtaactaaaataactattacgatcaaggtgatacaacgtatgtactgagagatccacgttttgttgaaaggttgtggctccacctcgtttttttatttttttgtgcttccacaatttgtgaaattaatatgtactcaatgatatgtcccgtcattggataattccacaatatatga

SEQ ID NO: 7269 - DNA, 370 bp, Triticum aestivum
  Clone ID: LIB3281-050-P1-K1-A3
ttccctcccttctctgacccgcgtctttcctcctcgacccgccggcggcgccggcgtcatgggcggcgggacgaagaccgtcgactacgcgggggaaagagcgctcgccaaggacttcctcaccaacttcgccggcccgcacggggagcccaagtaccagaacatcctgcaagacatcgcgaaccggaagatccgcgccgcccagatcgagctggacgacctgttccactacaaggatgtggacgaggagttcctgcagagggtcaccgagaacaccaagcgctacatcggcatattcgccgaggccgtggacgagctcatgccagagcccacggaggcgttcgctgtcgacgaggatagggacattttg

SEQ ID NO: 7270 - DNA, 380 bp, Triticum aestivum
  Clone ID: LIB3281-050-P1-K1-A4
cggacgcgtgggcggacgcgtgggaaagaatggcgggggacggcgagcttcttccccggatcgcggtggtcggcgcgggcatcttcgcgcgcactcagtacatccccaggctccgcgagatctcccacctcgtcgtcctcaaggccatctggagccgcacccaggaatccgcagaggctgccgcggagctcgcccgcgattttgcgcctggcatcgagtgtaaatggggcgacgcggggctggaggagatcatgggagacccttccatcctgggcgtagccgttgttcttgcaagccaagtccaggttgagctttccttgaagatgctcaaggcaggaaagcatgtgatccaagagaaacctgcctctggatcgacaacc

SEQ ID NO: 7271 - DNA, 235 bp, Triticum aestivum
  Clone ID: LIB3281-050-P1-K1-A5
accgttccgccgggcagagagacgaccataaataaagcttacacaacatagccaacaaggagaccgttcggacctggggctgccgccgtggcgcgtgtgccatgcatcacgattgcccaacaactaggattgcagaagccaacatgatgaaaggataatgcagcaaagacgcaccgttactcggacaagcacgagtgcaagtttgactaccgcgccgcgggcatggacgccatcg

SEQ ID NO: 7272 - DNA, 347 bp, Triticum aestivum
  Clone ID: LIB3281-050-P1-K1-A6
ggccgagctggggatgtgtacagtccgcaaggtcagggaaacggtggcagcttctccaggaggcaggatgatcaccttcagaccagtctttactcccttggttcttcaggtgctagatatgaccagattggttcttcaggtgctagatatgaccagattgtttcttcaggtgcaagatatgacccgcgatctttaacttcgccgtcttatgggctgttgagtacaactccacggagctcagtcatagacaagtacagtccagggttctcgggttcaagtggatctggaccgtcagtcatggacagctatgctcctggttacttgggcgcaaatgcaccaggaagaag

SEQ ID NO: 7273 - DNA, 321 bp, Triticum aestivum
  Clone ID: LIB3281-050-P1-K1-A7
gtgaacccaggcttccccgaccccttggccggccccttggaggggcctccggccccccgacggggaggttttaaaagccggggccaccgcccccctggtccagtactatgtcagcagccagagcgctttcttcgcagacttcgtggcaggcatgatcaagaggggggatatctcgccgctcacaaggaacaatggagagatcaggacgcactgtaggaagagtaactaaaataactattacgatcaaggtgatacaacgtgtgcaccgagagatccacgctgtggtgagagtgtggggtcccacctcgtttttttattttt

SEQ ID NO: 7274 - DNA, 369 bp, Triticum aestivum
  Clone ID: LIB3281-050-P1-K1-A8
cggactccttggctagacccctatggaagggctcctgcactccaaacgggaggtttttaaacggcggggcacaccgaccccgtgttacatctatatgagaagacacagcgctttgttcgcacacacttcggggcgcgtatgcaaaataggagatatctcgccgctcacaaggaacactggagagatcaggaaaaactggccgacgagatactaatatacctattaccatcaaggatatacaacgtctgtgctgtgagacccacgttcatggacaaagcccttgagcggcactttattctttattgttgtgggcggtgcccacacagtggaacgaatataattctcagcgctataaccgcccattgtata

SEQ ID NO: 7275 - DNA, 328 bp, Triticum aestivum
  Clone ID: LIB3281-050-P1-K1-A9
ggacgtgttgggcagatcatcgcccaactcctgtcagaacggttaattccatttgtagcgcttgatgttcgaagtgatcgggtggcagttgggcgcgcacttgatctaccagtatatttcggtgatgcaggaagcagagaggtactgcacaaagttggagctgagagggcatgcgctgctgccattactttagatactcctggtgcaaattatagagctgtatgggctctgagcaaatactttccaaatgtgaagacatttgtcagagcacatgatgttgatcatggtgttaatttggagaaagccggtgcatcagcggttgtccctg

SEQ ID NO: 7276 - DNA, 385 bp, Triticum aestivum
  Clone ID: LIB3281-050-P1-K1-B11
ggacatcatttccattcccaagactggtgagaactacaggcttgtgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaaccttcgagaccatccacgttgaggatgcccagggc

SEQ ID NO: 7277 - DNA, 383 bp, Triticum aestivum
  Clone ID: LIB3281-050-P1-K1-B12
cggacgcgtgggaacagaacaaacacgatatgatatttaaggtatgtgacacgctgacacaaacaagatattggacaggaaacagttctgaacttctgatgttccaaaattaggctaacccttcatagtaccagaaagctaaagcttcatgtcagaccttcacttcttggccttcttcggtgccgcagctggagctgcagccgctggtgctggtgcatgatctctgggaccctgggccaatctctcctccctcctggcaatcttcctctccctgcttgccttgctcttggcgcgcttggcctcaaactggtcagagagggtcttctctcttgccttctcagccttggacttgtggatactctccatgaggaccctcttgttct

SEQ ID NO: 7278 - DNA, 337 bp, Triticum aestivum
  Clone ID: LIB3281-050-P1-K1-B2
cggacgcgtgggcggacgcgtgggctttttttttttttttttttggttttttgaactataaacggcagtgccatgctgtcagtaaaactatcatgatgattcaggaatgttgctcgtgctgagacgggcctcacgcctcctcaacagcaagaaggttcatagcagttgattattcacgaccttcggagcgaaacgcctcacagaagaacaaaaaaaagggggcaaaaaacttgtgcagaccaaaacttttaaaacggtgtgtgcacaggccggacaacccgagcctgcgtaagggttattttttgcgagggtttcccgcatcaggggaacttgatcg

SEQ ID NO: 7279 - DNA, 359 bp, Triticum aestivum
  Clone ID: LIB3281-050-P1-K1-B3
gcacgacggtgacaccagcagtgggagcagcagcgacggtgacagtgggagcagcaacgccagcgacggcggcagtggtggcaacaactggagcctggcggagatggacgtcgaggacgggccgacggggcagttcagcgccatgctgaggaaatgcaacctgggcatgaagcaggaacagtacctgaacgtgccggtggatttccagctcgcgcacgggtacgcggagaggagcaaggtggagctgcggatgcgcggcaagtcgtggctcgtgcacctcaagcacaaccccaagacgggtggcaggccgcgggcgtctttcaggtacggatggcaccagttctgcgtcgacaacgccc

SEQ ID NO: 7280 - DNA, 377 bp, Triticum aestivum
  Clone ID: LIB3281-050-P1-K1-B4
cccacgcgtccgctctcgtgctcgccgccagccccggacagcgccgccccagctcaccgggagggcagcaagcaatggagcggagcctcccccccgtccccgtccccgcggcgcgcgtgtagtagggctccctccctccctccctccctccccccgcgcggctcctcccctgcaagaggcgttttgatccgcgaggatggcgatggcggcctacagcaaccaagcgcaggcgatgatgagggactacctgctcgccgacccgctcgtcccctacacctccgtgctcatcggcgttttcctctgcaagatggcttatgacctcacacggatattgagctcattctacttcaagggctattcttctttgacaaaaatac

SEQ ID NO: 7281 - DNA, 285 bp, Triticum aestivum
  Clone ID: LIB3281-050-P1-K1-B6
cggacgcgtgggccccacctcctcactcccacctctccctcactcgccacctgcgaagctccagcggcagccatggcccccaaggcagacaagaagccggcggccgagaacaaggtcgagaaggcggcggagaagacccccgcgggcaagaagcccaaggccgagaagcggctgccggcgggcaagacggcgtccaaggaggccggcggcgaggccaagacccggggcaagaagaagggcagcaaggccaagaagggcgtggagacgtacaaaatctacatcttc

SEQ ID NO: 7282 - DNA, 279 bp, Triticum aestivum
  Clone ID: LIB3281-050-P1-K1-B7
ggcacgcgttcgggccggggctgcggcgaaaactaaggcgaaaacaatagctacaacactagctacaacaccaactataacggacattataatggacttcgtcgtatcctcagtcgcatcggcagtcgccatggccgccgcctctggattgacctatatacttacctacatccgtatctacggcctagagctggccctagagctcggggagggtccaggcgagggacaacacgtcggaaaccactactaaatacagttctatggaaagcaaggttggaa

SEQ ID NO: 7283 - DNA, 382 bp, Triticum aestivum
  Clone ID: LIB3281-050-P1-K1-B8
cggacgcgtgggtttttttttttttcacaagacaaaaaacgtatgattttcatgaatttacaagacaaaacaaccattaacaacaaaataatattccacattacatgatttttgacgagctaattttacatgacaagactcccactgttacaatctgcagagcagcggaaggaacagcacctagctagaaccatggacacaagacttaaccggccggagtcactgaccagtgaccgaccaccggagacgccgggcacaaaaacgccggcttatagtcatccgggacggactaaccaaaccctaccacaagagaacaaataatagatctacacaatgaacaaggattagagacttagagctaatccgctaaaagcccgtgcag

SEQ ID NO: 7284 - DNA, 291 bp, Triticum aestivum
  Clone ID: LIB3281-050-P1-K1-B9
acactcgctccggcctgaggccggagggagatctcctgtgccgcaagagcttcttcttcctccccactcttccgctaaatactacaaaacctctccatccctttcccgcgaggcccaaaaatatcaaaaatcctcggcgcaaaccctagcgcccgcacctccctgcgtcgccgacgcggagccggagctcccctgctgcaaccggcggcggccatagaagcggtggtcgtcgacgcggagtccaagctgatgaaggccggcatcaagctgcccgaccaggccccggggctg

SEQ ID NO: 7285 - DNA, 387 bp, Triticum aestivum
  Clone ID: LIB3281-050-P1-K1-C1
cccacgcgtccgcggacgcgtgggtgcgcctccacttccatcgcctcccaagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggctaaggaagagagcgatgatgac

SEQ ID NO: 7286 - DNA, 383 bp, Triticum aestivum
  Clone ID: LIB3281-050-P1-K1-C10
cccacgcgtccgccggcgcccctctcctccatttattaatcccgggttccacgagagagcagagagagtggagcggtggactgacccgggggacgaggctcgactccttttctctttctcgcgccgctgtgccgcctgcttcttgcctgcccgcctttccaccaccccgtccctctccttcgtgctcctctcctctcatcctaagacgacgcgctgcagacgccgaggctagcagccagaggccgggcggggcaacgggcgccggccatgccgagatccagggggtccgagctgccgcagcgggcgtcgccgcgcgcgccgctgcacctcaagaccacggcctcctccgaggccaatggcgcgcaccaccgcctcgttgtcga

SEQ ID NO: 7287 - DNA, 331 bp, Triticum aestivum
  Clone ID: LIB3281-050-P1-K1-C11
cccaaccaggcgaaaagccgcatcgcgaacggcaccagaccaaacccccgaatccgaaccaagtagcatgggtaaagccccatctgcggcggcggcggcggcgatggagtcggtggaggcgctcgtggcgcacatccagggcctctccgggagcgcggacgagctggcgcagctccacggcctcctcaagcaggccgacggcgacgccctgcgcgcccactccgccggcctcctgcccttcctctcccacctccaccccggcacccactccctcggctacctctacctcctggattctttcgtgtcgtcgtctgctaatctgagggcccac

SEQ ID NO: 7288 - DNA, 387 bp, Triticum aestivum
  Clone ID: LIB3281-050-P1-K1-C12
cccacgcgtccgcggacgcgtggggcaatggaatggggtcaagaagcagccgtctgtgccaaaggattggtgggtcgaggatctcacagatcttgacattgattcctacaagcaagtcatatcagctatcaaaacaatgggtatggtgcccaaggatgctgttggtgaagcaatcaaagcctacacatacaagaagctccccctcattaagcaaggtttcaatgatccatggtgatggaaaggtccgagcgatgctagttaccatcacatgcttgctaccatcagagaaaggctcagtctcatgcagcttcctgctaaagctactgagggcaaccaatctgcttaaatgtggagagatgtgcaggaaagagctggtgaagagaattg

SEQ ID NO: 7289 - DNA, 211 bp, Triticum aestivum
  Clone ID: LIB3281-050-P1-K1-C2
gctcagccttcgtctggggagcaagcaacatacttgatttcaccatgactggggcccatacgttcagaatgctcccccatatcttccagcgaggtttgctgctcaatacccagcctcatgctggaaattacaataccgccataactccaacgaagattgcccctggagaaacgctgtctgattcaaaggcgaagactagcagcatagatct

SEQ ID NO: 7290 - DNA, 344 bp, Triticum aestivum
  Clone ID: LIB3281-050-P1-K1-C3
catctatgacccggacttcatcgctgccaaccagggctcccgggctaacaatgtcatcaagggcacaaagaaagagcagatggagcagattatcaaagacataagggagttcaaggagaagaacaaggtggacaaggtagtggtgctttggacggcaaacactgaaaggtacagcaacgtctctgttgggcttaatgacacgatggagaacctcttggcgtctgtggacaagaacgaggcagagatatctccgtcaacactgtatgccatcgcctgcgtcatggagggtgtgccattcatcaacgggagccctcagaacacctttgtgcctgggctgatcgatc

SEQ ID NO: 7291 - DNA, 120 bp, Triticum aestivum
  Clone ID: LIB3281-050-P1-K1-C4
cggacgcgtggggactggccgtcggtcgctttctcctccgcccttctcctctacggcggcgcccggccgcccagctgctcaccgccggcgctctcgccgacggcgatgtcgtctttggag

SEQ ID NO: 7292 - DNA, 391 bp, Triticum aestivum
  Clone ID: LIB3281-050-P1-K1-C5
cccacgcgtccggtagtttctcttttacacgcaccagttcgcatgaaagcttgctaggtgaaactttattattctgtgactacatacatataaatttaaaaaattagacacatctctaaaatctgaagtgtgtatagttaaaaaatcaatcacctttttatctggcatgtgcttcttcattaattaggtatcatccatcaattcctgtgaaacatatgtaagatgaattagttaaggaattctaaagatggtacttcatatttaaaaaaaaaagttaaggcaactctacctcctcggtttatcgttcaagtagagcatctcaagcctattatcaggcacaaatgtatttttactgcatagttttgtgtgtcaaaggtaatattatatcatt

SEQ ID NO: 7293 - DNA, 390 bp, Triticum aestivum
  Clone ID: LIB3281-050-P1-K1-C6
cccacgcgtccgctcgatttctcttgtattaattgcctttcgtgttcttgttacaaacttttacacgcagcagaattacagcagaacaagtgccccatgcattgtatatccgctgtgcactctactaaacatacataatgctcttatcatcttttgatctcccttgagatgtaaatgccactacttttagataatggcgttggtaggctgaaggttgtttgtttgggagcaaatgccttagtatccccgcttctgctaatttcaagcccacatattctacagagatcttccagctccaactcctcgatcatcaggatatctgacagatgtgtcaaaggatggtgctgaagtttgtagccgctatggttgaggtacattaatgctctagca

SEQ ID NO: 7294 - DNA, 345 bp, Triticum aestivum
  Clone ID: LIB3281-050-P1-K1-C7
ttccaactcacactttctccctctttgcttcgctcgctgcttcttctcttgttcccttttctcgtctctatccaactcccactctgccacctataaattccagccaccaccattgaattgagtcgattgcgcagaattcttgcagctgattgcgccggaaacttgcatcgtactagatagtgcgtgtacctagatagtcacgtacatatacatggccgcgtggctggcgcgtcgggctgccagaaggctcgctggcgagctgtgcagccatggaccagggccgtggcccttgagcttgtcgacggtgccggttctcggggtgccatcaggggaccaaagcagggg

SEQ ID NO: 7295 - DNA, 382 bp, Triticum aestivum
  Clone ID: LIB3281-050-P1-K1-C8
cccacgcgtccgcggacgcgtgggcaagtacagttggttcgtctgagtcatctggatcgcttgccagagagaagggattggagtcgtatgttgtccaactacagcgaagtgtcacagaactcgctgaggaagtgcagagattgaagctgagaaataatcagcttgagcagcagatcaacgggttgtcgaaaaaagacgaaaggttgcgaagagagggtagtaccaagcaatgatatattatattcccccctagtccccgttgtataattcagctccccaattttgaacctggttagtgaaattaattgtattatgtttcgaaatcaggtagttgaatcaattgtaattgtaagtattttagcgagttcacattatagtataa

SEQ ID NO: 7296 - DNA, 304 bp, Triticum aestivum
  Clone ID: LIB3281-050-P1-K1-C9
cgctagtccaaccctggcgcgctcgcccgcaatgccggccaccgactcctccgcctcgccggcgcaccaccaccaccaccacacctccttcggccgccacatcctctcgctccgccaccgcgaccacggccagatccactccgccccgcccacgcccgaccaccccaacgccgccgccaacgccaacccccacccctcccccgccgaccgcgaagtcgacgcctttcagcgccacgccgccgagctcctactcgacctgctcctctgctcccccgacgccgccccggccgacgccaagaatgcc

SEQ ID NO: 7297 - DNA, 341 bp, Triticum aestivum
  Clone ID: LIB3281-050-P1-K1-D1
cggacgcgtgggcggacgcgtgggatcgccagcagctggggcaagggtttggggatttgctctgtccgaaggatcatcctcgcagcgtcttgttgggcttattaaagtctttattagtcgggcattgtcaccatcaggattgaattcagagcagactgatggtcttgttattgcttccgccaaactaataaaaagcttatctgacgagggctctaatttggttgctttgagagagtgctttgcaaatgctaaactgaagctgctctttaaaactgcagtttctgatggtgcccaggctgctcttctcagcatggtgccagtggtatcacctgatgatctat

SEQ ID NO: 7298 - DNA, 369 bp, Triticum aestivum
  Clone ID: LIB3281-050-P1-K1-D10
accttatcgccaagaaagacaaggtttgagccctgggggaaggacatttcttatggccagccgttagatccaaaatgatatacatggaatattctaatggctctcaaaagacaaatatgcccatgtatttggctttcaaaatgtatcttttcaagggcacgtctgtcttttagctttaagcacatgcttggacagttaaagcgaactttggtcacaaggtcaaccaaaaactatctaggtcagatggtttttgttaagaggagcaacttgttttatattgcagagcccaatgcctaaatataaaatacaatggacttggagtacaaggaaggaaatttaggctaattgacacctagaccgatactagtt

SEQ ID NO: 7299 - DNA, 389 bp, Triticum aestivum
  Clone ID: LIB3281-050-P1-K1-D12
cttgcccgagacaaatagcttccaacatatgaaactgcagacattcttgaaattggatcctctttcttctccgtaacaatgtcggtaagaaaaacagcaaaatcctcaccaagggttttaggatccagtgagcaggtatagaaaatgataaactgggcaaattttgatctgtggactctcagcagagatgctcgaaatatagttttcagaatgacaaattccttatataggcactgacgatctaatgacttcaggtgctcacatacaacaaccattaaaccatcaagcttttcagcacatgcatttcctccaaaacagacctttgttcctgcttgtccaaagccatccccatcatcatcggcatccaaatcttcaagttccatttcaaa

SEQ ID NO: 7300 - DNA, 309 bp, Triticum aestivum
  Clone ID: LIB3281-050-P1-K1-D2
cgtcgatcctgggggacaccatcgactacatgaaggagctgctggagaggatccggcggctgcaggaggagatggaggagccgcatgccggtccggcggcggcgccgctgctgagcgtgttccgggagctcaaccccaacgagatgctcgccaggaacacccccaagttcgaggtggagcgcaaggaggaggacacccgggtggagatctactgcgcggccaagccggggctgctgctgtcgacagtgagcacgctcgacacgctgggcctcgacatccagcagtgcgtcgtcagctgcttcaacgact

SEQ ID NO: 7301 - DNA, 310 bp, Triticum aestivum
  Clone ID: LIB3281-050-P1-K1-D3
cacccagctgctcactcatcgagacacctgtgctgtgcctgtgctcacattgtgcacatgtgtacaatcgtcaacaaatccaaagcatcctcccagtcgccgaatccaaaacatatttagcgctcgcctctgtttcttcctaagctcagagatccaaagcatcctccttcttctggggtaaattggaagatgtctaccaagttgatagcgctctacattacagtttgctctgttctgtttatcatatccaagatgctcatctccttcctctgctacaagaaggggggctcgcaagaagaggatcatcgag

SEQ ID NO: 7302 - DNA, 350 bp, Triticum aestivum
  unsure (1)...(350): unsure at all n locations
  Clone ID: LIB3281-050-P1-K1-D4
agcattcccatccaccgccgccgccgcagccgcccgccgcattccgagcggttcgagttcgccggagagggaggagagatggccaggaagggcggagagaggaagaaggcggtgacccggtccaccaaggccggcctncagttccccgtcggccgcatcgggcgcttcctcaagaagggccgctacgcgcagcgcgtctgctccggcgcccccgtctacctcgccgncgtcctcgagtacctcgccgccgaggtgcttggagctcgccggcaacgccgccaaggacaacaagaagacccgcatcgtgccgggccacctgctcctcgccatccgcaacgaccaggagctcg

SEQ ID NO: 7303 - DNA, 150 bp, Triticum aestivum
  Clone ID: LIB3281-050-P1-K1-D5
cggacgcgtgggcggacgcgtgggctcctccccttccggttcgggttcgggtgctggttcggttcgggtccgagagtagctagcctagtctagggtttccgtagagaggaggaggagaggaagagagagatccatggcggagacggagta

SEQ ID NO: 7304 - DNA, 374 bp, Triticum aestivum
  Clone ID: LIB3281-050-P1-K1-D6
cggacgcgtgggtttgtggcgtatccatggtgtggattattatggcatgtctgagacaaatgagccaaaaggtctaaggcatgtgaaagcagactcaaggacatatgatgggcctagctcaaatacagctgaatgggaggagaaacttgattcattctggcaagacaggattcaaggtcaggatccattagaaatattgaaagcaaaggacaagattgatgcagctgctagtgaagtgttggatccacatgtcaggaaaataagggatgagaagtatggatggaaatattgcttgggagctaaggggtgcacaaagcttttccatgcttctgagttcgtcacgaagcatcttaaactcaagcatactgattttg

SEQ ID NO: 7305 - DNA, 243 bp, Triticum aestivum
  Clone ID: LIB3281-050-P1-K1-D8
cccacgcgtccgcccacgcgtccgcgcccgcccgcccccgccggcgccgccgcctccttccgcaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccggtttggt

SEQ ID NO: 7306 - DNA, 321 bp, Triticum aestivum
  Clone ID: LIB3281-050-P1-K1-D9
accttatcgccaagaaagacaaggtttgagccactgcctgaaactcacatttcttatgtccagccgttagatccaaaatgatatacatggaatattctaatggctctcaaaagacaaatatgcccatgaatttggctttcaaaatttatcttttcaagggcacgtctgtcttttagctttaagcacatgctgagacagttaaagcgaactttggtcacaaggtcaaccaaaaactatctaggtcagatggtttttgttaaaaggagccacttgtcttatattgcagagcccaaggcgtaaatataaaatacaatggacttg

SEQ ID NO: 7307 - DNA, 219 bp, Triticum aestivum
  unsure (1)...(219): unsure at all n locations
  Clone ID: LIB3281-050-P1-K1-E1
gcgggacatcaaggtgcagaagctcgtcctcaacatctccgtcggcgagagcggagatcgcctcacccgcgcctccaaggtgctggagcagctgagcggacagtcaccggtgttctccaaggcgaggtacactgtcaggtcgttcggtatcaggcgtaatgagaagatcgcctgctatgtgactatcaggggtgagaaggcgatgcanctgctggagag

SEQ ID NO: 7308 - DNA, 238 bp, Triticum aestivum
  Clone ID: LIB3281-050-P1-K1-E10
aacacaccacggcaggaaagagaagaatctcaggcccgtcctaatcgcaccggcgacaacgcgagcgagctagctagctccggcgaggccggagacgtccatggagtacaagaggtcatcgcatgtggaggaggacgaggagctggaggaggaggaagaggaggaggacgatgaggaggaggaggaggagggagaggaccaggagggggcgatgagggaccgtcggcaccagcatcag

SEQ ID NO: 7309 - DNA, 391 bp, Triticum aestivum
  Clone ID: LIB3281-050-P1-K1-E11
cggacgcgtgggggccactcgtcgctcgtcaaccctagccgccagcgacgaggccgtcccgacgccgccatctctcgtcgccggtgaacttcgtccggcgaccccctcaccaccccgactaccgtctggtcctcgagccgcccttccccgacaccgcgagtccgtccttcttcccaacctgccagcagccgacccctgccgccggcgacgctgctcttctcccccgccgtcgccacttcagaggctcaagcggcggcggcaaaggcggaggcagaggatccaagatgatcatcccggttcgctgcttcacctgcggcaaggtgatcgggaacaagtgggaccactacctcgatcttctccaggccgattacactgagggggatgctctgga

SEQ ID NO: 7310 - DNA, 374 bp, Triticum aestivum
  Clone ID: LIB3281-050-P1-K1-E12
cggacgcgtgggggccactcgtcgctcgtcaaccctgtgcgtctgcgactaggccgtcccgactcctccatctctcgtcgccggtgaacttcgtccggcgaccccctcaccaccccgactaccgtctggtcctcgagccgcccttccccgacaccgcgagtccgttcttcttcccaacctgccagcagccgacccctgccgccggcgacgctgctcttctcccccgccgtcgtcacttcagaggctcaagcggcggcggcaaatgcggaggcagaggatccaagatgatcatcccggttcgctgcttcacctgcggcaaggtgatcgtgaacaagttgtacactacctttatcttcttcaggccgattacactg

SEQ ID NO: 7311 - DNA, 213 bp, Triticum aestivum
  unsure (1)...(213): unsure at all n locations
  Clone ID: LIB3281-050-P1-K1-E2
cggacgcgtgggcggacgcgtggcggacgcgtgggggaaaccatggtgcagtggtacaatgaagctgttgctgccggcaaggactctcatgtcgtgaagaatgccaagcccgtcgtggagtggctcgagagcgccnagtccgacgaggagtgagacgctgtactgcttgctccctatcggcatatcctttttaccaccactactgcttaagtg

SEQ ID NO: 7312 - DNA, 324 bp, Triticum aestivum
  Clone ID: LIB3281-050-P1-K1-E3
attccaccagcgcacgcaacaaaatgagattaacaaggaagaagcaaaccatcttcagcaatgcagctctctgctcccccgacactgtcagatggaactcaaacttggagaagtacgagagtactgatgggatgataatatacatgctcacgaagatgaggacattgggtagaaactgaaagattattgtccagaaccagcttgagccttgaagccaaacaatccatgatttggcattatccatagcctccacattgatgatccgtgctgcgttttgcattccactgagtattgacaagggcgaactggaaaacaggagcatta

SEQ ID NO: 7313 - DNA, 284 bp, Triticum aestivum
  Clone ID: LIB3281-050-P1-K1-E4
catagacactgtagtatcaccagttcactgcgcaccgacagccaaactagcaccgggacgcggaatccgaggcacacgcccatggccaacaacgaggttcgcatcgtccgcggaggagtctctgaccactctcctgctcgagccagcggcgagccccggcgacccgtcggtggaggtgagtctgtaccggcggtgcgccggcccggccaaggtcttccgatcgggcctgaggggccctcgccgcgaccgcctcgacgtgcgcggcatccaggcagagcacgggc

SEQ ID NO: 7314 - DNA, 365 bp, Triticum aestivum
  Clone ID: LIB3281-050-P1-K1-E5
tctttcccgcacaaacaagcctgcacattcccccctccctcggagcagcgatggcgcccaaggcggagaagaagccggcggggaagaagcccgcggaggaggagcccgcgacggagaaagccgagaaggcccccgccgggaagaagcccaaggccgagaagcggctgccggcgggcaagaccgcctccaaggagggcggcggcgagaagaggggccggaagaagggcaagaagagcgtggagacctacaagatctacatcttcaaggtgctcaagcaggtgcaccccgacatcggcatcttctccaaggccatgtccatcatgaactccttcatcaacgacatcttcgagaagctcgccggggag

SEQ ID NO: 7315 - DNA, 215 bp, Triticum aestivum
  Clone ID: LIB3281-050-P1-K1-E6
cagaaaggaaacccggaaaagaaaacagagcaggactccactccacactccactctcctcccccctcctcactctttcttggatcgtaaggaaacggaagaaatacatccgcgatcgtggaggggacattttgatcggtgttggtttcccaaggccgagacgagggtacgtggtggtcgtcatggatccgggcctggaccggaagaccgggaagg

SEQ ID NO: 7316 - DNA, 247 bp, Triticum aestivum
  Clone ID: LIB3281-050-P1-K1-E7
gtcacagctcactccttcaccaacaggcaagaacttgggctgctgcgcgttggccatggcagcgatgaaacccgtcctgtacagcgcggcgatcagctcctgctcctaccgggtccgcatcgccctcaccctcaaaggcgtggaatatgagtacagggcgggggcatggaatgatacagagtatgagaaaatcaatccaattaaggatgtgccagcactacaagatggggacatattggtttcagac

SEQ ID NO: 7317 - DNA, 223 bp, Triticum aestivum
  unsure (1)...(223): unsure at all n locations
  Clone ID: LIB3281-050-P1-K1-E8
cggacgcgtgggcgccccgctgacctcaaccagccggcggcgaaatggcccctaagcgaggcggcaaggcgccggtcccggcgaagaagaaaacggagaaggtgaccaacccgctgttcgagaaaaggccgaagcaattcggcatcggcggcgccctcccgcccaagaaggacctccaccgcttcgttaagtggcccaaggttgtgcgcatncagcgccagcg

SEQ ID NO: 7318 - DNA, 217 bp, Triticum aestivum
  Clone ID: LIB3281-050-P1-K1-E9
caaaactgaaggattaacgtccacgataattgtgcaaataacataaccaggcatcatatcgtccgcctctcgacatagaaacatagagttccagtagaaagcaacaaaaaagctaagtttggtgatcagggctccgcctagcgtaacaagttaaggccgccacgcctagttgccgctggaagaggctcccttgctccttggtgtggcctcagttccc

SEQ ID NO: 7319 - DNA, 373 bp, Triticum aestivum
  unsure (1)...(373): unsure at all n locations
  Clone ID: LIB3281-050-P1-K1-F1
cggacgcgtgggcggaggtggggacatgtttgatttgtgcttgaatgcgctcgcagtccatggacgcctcattgtaattggtatgatctctcagtatcaaggagaggagggatggaagccgaagaactacactggactatgtgagaagattcttgctaaaagtcaaactgtggctggatttttcctggttcaacatgctcacatgtggcaagatcatcttgacaaactatttgagttgtatgcctctggaaagctaaaggtctcgctcgaccctaagaaattcctgggcgttgcttccgcagtggatgcggtagagtatcttcattctggcaagagcgtcngcaaggtcgtcgtctgcatcgatccagcatac

SEQ ID NO: 7320 - DNA, 357 bp, Triticum aestivum
  Clone ID: LIB3281-050-P1-K1-F10
cattgctatgatgggatatggccctgaagacaaacatgctgtactggagttgacatacaattatggtgtgaaggaatatgataaaggaaatgcttatgcacagattgctattggtactgatgatgtctacaagaccgcggaagtcgttagacaaaatgggggacaaataactcgtgaacctggtccattacctggcattagtaccaagataactgcctgcacagatccagatggctggaaatcagtatttgttgacaatctagattttctcaaggagttggaagaatgagttttcaagaagatatcatcttcgtacaggtttcactggccctttttcctcgagttgctagccccccc

SEQ ID NO: 7321 - DNA, 394 bp, Triticum aestivum
  unsure (1)...(394): unsure at all n locations
  Clone ID: LIB3281-050-P1-K1-F11
ctttgacctccacccgattctcgtcgatcgaaagacatccccgagtccccacccacccaccgagccctaaccctaaccccggctaccgaagatgccggcgacggcggggcgcgttcgcatgccggcgaacaaccgcgtgcacagcagcgcggcgctgcagacgcacggcatctggcagagcgccatcggctacgacccctacgcccccgagaacaacaagcagcaggccccctcctcctccgtctccgccaacgccgcagccgcggcagccaacgccgtcgccgaagccgccgcgcctnccttctcggaccccggggcctcgtcggagaacgcctacaccagctttcagggcctnctcgcgctcgcccgcgtnaccggatccaactccgacgag

SEQ ID NO: 7322 - DNA, 379 bp, Triticum aestivum
  Clone ID: LIB3281-050-P1-K1-F12
cccacgcgtccgcccatccagcgcaaccgccgccaacaccactgctcgagattcctcgccgccggagaagtagcacgcaggatggccggaaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgccgtccgcaacgaccaggagctcggcaggctgctcgccggcgtcacca

SEQ ID NO: 7323 - DNA, 387 bp, Triticum aestivum
  Clone ID: LIB3281-050-P1-K1-F2
ctttatactgctgttctggaggaaaggagttctgcagccaaaagggcctttgcgtcttcttgtgctgcagttttgaaatatgccagccaatctcaggctcagaaacttattgaagacaccgcttctctgcatttaggtgaaaaaagttctcagtcatctggtgcagttcttattaaatcgtacttgagcaatgcagcagatgttattagtggatacaatgcagcggttatccctgtaattttttcttcaagatttgatgatgataaagagaccagtgccttgtatggagaactttgggaggatattcctagcagtgaaagagtaacccttcaactttatttaccaaaaattgtatcccttttgtgcgattgcatgtcctcatcatca

SEQ ID NO: 7324 - DNA, 78 bp, Triticum aestivum
  Clone ID: LIB3281-050-P1-K1-F3
ctctcttctatttctgttgcccggaggtcttgggtgataaggacgagttcaaatcaagatatgaatcggctatcattc

SEQ ID NO: 7325 - DNA, 308 bp, Triticum aestivum
  Clone ID: LIB3281-050-P1-K1-F4
cggacgcgtgggcaggctttgccgaacacactcaccgtttcgccaggtgagaggagaagcccgcagcgccggtgcttgagcggatcgggaaaggatggccggcggcgcggacccggacggggagcgccggatcggggtggccatggactactcggccagcagcaagcccgcgctggagtgggccgtccgaaacctgctccgccggggcgacaccgtcgtcgtccttcacgttcagcgccacgggggggaggacgccaagcacgccgtctgggccaagtccggatccccgctgatccctctgtcggagt

SEQ ID NO: 7326 - DNA, 398 bp, Triticum aestivum
  Clone ID: LIB3281-050-P1-K1-F5
cggacgcgtgggcggacgcgtgggcccgccgccgcctcccctccgttcgttcttcttcttcgagttgggtagttcagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagaaaggtatcaccatcgatattgctctctggaagtttgagaccaccaagttctactgtgcccggatttgatgcccctgtcaccgtgacttcatcaagaacatg

SEQ ID NO: 7327 - DNA, 309 bp, Triticum aestivum
  Clone ID: LIB3281-050-P1-K1-F6
cggacgcgtgggcggacacgtgggcccacactcacctcccctccgcgcgttagggttattccagttgggcagttcatctctacccaccaaccatgggtaaggagaagactcacatcaacatcggggtcattggccacgtgtactctggtaatgtgacaaccactggccagctcttctacaagcttggaggcatctgacaagcgtgtcatcacacaggttcgagacggacacctctgagatgaacaagaggtctttcaagtactcgtgggtgcttgacatgctcaaggccgatcgtgagtgaggtattac

SEQ ID NO: 7328 - DNA, 383 bp, Triticum aestivum
  Clone ID: LIB3281-050-P1-K1-F7
aaccgaacgaccccgtccgcccgccgtagatcacaaggagaaagggatcgaccccgccgccgccgacgccgagagacgatgagctatcagcaggtccctccgcaggaggcctacccgccgccagggtattcgccggtgtacccgccgccggcgcccggcgcgcagcagggcccgtactacccgccggcgcagcagcagccgccgccgccgccggggtaccagggatacttcagccagggccaaccgcagcagccgccgccctactactacccgccgccgtcgccgcacggtggccatcaccaccacggccaccaccaccatgaccaccacgccgaggaccaccaccaccaccatgggcaccatcaccaccaccaccacaacga

SEQ ID NO: 7329 - DNA, 380 bp, Triticum aestivum
  Clone ID: LIB3281-050-P1-K1-F8
aaattagcaaaccactgttgagaatattcgaaccaattctcaacagtggtttgctaatttggttctcacaacttggaacaatggctccacggggatgttgacctgtaagtccccttacatgggaacacaggatgaagatcatattagggacggcaaaagggttaatgtatttgcatgaggggcttgagccgaaggtggttcaccgggacgtcaaggcaagcaacatccttcttgataagcactggaatgctaagctctccgatttcggacttgcgaaactcttaggcccagagcggagttacgtaactacacgagttatgggaactttcgggtatgttgctccggagtatgcggggacttggatgttaaacgaaacaagc

SEQ ID NO: 7330 - DNA, 358 bp, Triticum aestivum
  Clone ID: LIB3281-050-P1-K1-G1
cggacgcgtgggattatcagctgattgacataactgatgatggatatgtcagggttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggtgaaacaagtttgatccagatttgtgtgttttttaca

SEQ ID NO: 7331 - DNA, 374 bp, Triticum aestivum
  Clone ID: LIB3281-050-P1-K1-G10
aagaaatactccctccgtcccataatataagaacatttttcaaagcttgaagaatgttcttatattatcggacagagggagtagttcgattgcagcaccactcccatatctttttcagttgacattgttaggtactcgctccgtaacaaatgtaagacgttttttatgccctatgtaaaaccaaaacgtcttacattttggtacagaggttgtatttgctccacttcacattgaagctagcaacttaatttcttttcttttatcaggtatttgcctttgtgaccgctgagtatgaaaccgcgaagaatttcctgaaccaggtatgccaatatttgcatttaatcctggtctacgtttttctaccactatctata

SEQ ID NO: 7332 - DNA, 328 bp, Triticum aestivum
  Clone ID: LIB3281-050-P1-K1-G11
cccacgcgtccgcaaatgcccagttggagcatgccaaggcatcagttgctgcctttgctgaacagcagggtatgctgaaatctacagtatctgacatggaacatatgattgaagatttgaaaggaaaggtttcaaaatctgaaaccagagccctaaatgctgaatcaaagtgtgcattattagcagacaccaatttagaacttagtgaagagctatcgtttctgagaggtcgagttgaacgcctagagagctcgttacatgaagctaaccatgtgaaagtagcaaccatcaaggacattagtctcagaactaaagttattaccggaat

SEQ ID NO: 7333 - DNA, 383 bp, Triticum aestivum
  Clone ID: LIB3281-050-P1-K1-G12
cccacgcgtccgcagaatcttctgactccgaatcatcggatgaagatgactctggaaggatatccgtgtgtggcgaggatagctgtgatccggatcctaaatttgctaggagttcttcgttcaaggcggatatttttcggtctagcagaacctcagaggacttcgcgacatggcaacgcattataaggctggatgctacccgggcaaatgcggaatggatttcgttctcccgtaaccaggccgaagtccccaaggagaaagccctacagtctgcaacatctgttgggttgaaagattatgaccatttggagccccatatgatttaccatgctgctcggttggtcggacttcttgaagcgtatgcgatctacgatccggagatc

SEQ ID NO: 7334 - DNA, 303 bp, Triticum aestivum
  Clone ID: LIB3281-050-P1-K1-G2
cccacgcgtccgcggacgcgtggggttagcacgtaccgtgaccacgtccacgcgctgtccaagggtgtcccggcccgtgcagtcatggcagagctctttggcaaggccaccggctgctgccagggacaagggtggttccatgcacatgttctctgaaccccacaacctgcttggaggctttgccttcattggcgagggcattcctgtcgccactggcgccggctttgccgctaagtaccgccatgaggtgctcaagcagtctagccctgacgggcttgatgtcacgcttgcattctttgggga

SEQ ID NO: 7335 - DNA, 354 bp, Triticum aestivum
  Clone ID: LIB3281-050-P1-K1-G3
cccactcgtacgcggacgcgtggggttagctcgtaccgtaaccacgtccacgcgctgtacatgggtgtcccttccagtccagtcattgccaagcttttctccaatgccaacaggtgctcccgtggacagggtggttccatgcacatgtgctctgaaccccacactctcctcggaggctttaacttgattgacgagggcatacctgtccgcactgtcaccaacttctccgctaagtaccgacattaggtgctcaagcagtgtagccctgtcggcctagatgtcactcttgaattctttggagacggtacctgtaacatcagtcagttctttgagagccttgacatggatcacctg

SEQ ID NO: 7336 - DNA, 251 bp, Triticum aestivum
  Clone ID: LIB3281-050-P1-K1-G4
cggacgcgtggggtgagtggccacgggttccttgggcttgatgcagtgtatgacaggtgacagcacaagtggcaagcgatgtgctcatgtggatgtagtagatattctcaaaaaaaaaatgtggatgtagtagatgtggtggccatatggataatggaactggcagcagctcagaatgtatgtagagaacacacacacggcatgtatagtcgcaccccccatgatgtgaatgaaataataccttcgttggt

SEQ ID NO: 7337 - DNA, 374 bp, Triticum aestivum
  unsure (1)...(374): unsure at all n locations
  Clone ID: LIB3281-050-P1-K1-G5
gcctaattcaacagttcaagctgctttacttagggagtcttcaaactcaatggagcaaaaccaaagaagcgatgttcctatatcacaggatgcatcaaatgcaactgctggagttgagttggcgcttgttcctcgatttgttggctctatgccacccactgcaccaagagttatggaaactggtaaggagactggtggaaggagcttcaacacaaaaccttctgacaacatctttcagaatggctcctcaaagcctgaaagagagccagggaattcgtcaaacataagatcgggcaaattcgaggatgctggccacaaggatggatgccccgaagcaacttatgagtactgtgtcanggtggtgaggtggcttg

SEQ ID NO: 7338 - DNA, 384 bp, Triticum aestivum
  Clone ID: LIB3281-050-P1-K1-G6
gtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccctattctgcagaagatgctcgaggcttgctaaaagcagcaatcagggatccagaccctgttgttttcctggaaaatgaactactctatggtgaatcgtttcctattaaggctgaagtacttgattctagcttcagtgtcccaattg

SEQ ID NO: 7339 - DNA, 308 bp, Triticum aestivum
  Clone ID: LIB3281-050-P1-K1-G7
cggacgcgtgggccgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgcttagtgatgtggatggcctctacagcggtccaccaagtgaaccttcatcgaagttaatacatacttatatcaaggaaaaacattatcatgaaattacttttggagacaagtcccgtgttggta

SEQ ID NO: 7340 - DNA, 353 bp, Triticum aestivum
  Clone ID: LIB3281-050-P1-K1-G8
caagcgccccgtcccctgccacagccacgacatcacggtcgtgcgccacccaccttcggatccctccacccgctcgcgcccttgctccctctccgcctgcggggccgcacccctcgcgctgctcctcgacgacgcggggctcgtccaagtggcgagcgaccggtggcggcggcaccagcgttgtcgtgaaggggccgcgagtggcgggcgacccgcacctcttccatctttccaccaaacgccgccgacctccttttctctcccaccatcgaccttcttttcccagccaaccccaccgacgaattacgcggtcttcccatccccgggggcctcctccctcgaccccgtcggcg

SEQ ID NO: 7341 - DNA, 148 bp, Triticum aestivum
  Clone ID: LIB3281-050-P1-K1-H10
aagcatattccctcccttcatactataaccacagtgctcttagctaatataatgttcccatatcacccgcttgaataaatcattccatttcaataccactcccatctctttttcatataacattcttcgcaaattactccccaaccac

SEQ ID NO: 7342 - DNA, 399 bp, Triticum aestivum
  Clone ID: LIB3281-050-P1-K1-H12
tcgcggacgcgtgggcaggaggcttcgccgcagccagagccggatctctctgagtctgttcctcataccaacgaggatgaggatcccaaggaggaggtttacaacccaccgaatgacgtggaagtgcctgttgtggaggaaacaccggttcctgaggtcatagatgaagtgccaaataatgtagcagcctccataccggtttcggctccccctgtaccacatgacgaggcccctaagaagtcgtacgcttcaattgtcaaagtcatgaaagcagttctggcaccaaattccgcaattccttacaggcctgcaccaccaaaaccggagaagcaagctcctgctcctgccctgtctgtggctgttgatcctccaactttcaatcctaatcctgagagcagc

SEQ ID NO: 7343 - DNA, 374 bp, Triticum aestivum
  unsure (1)...(374): unsure at all n locations
  Clone ID: LIB3281-050-P1-K1-H2
ccggccgccgccgtccctaccccgtcaggttgtctcgcagccgcgccgcctactctctcccctctcggccatcgacccgccgtctccccgtcgtttgcggcgccccccggctgcctacatctgcacctggtgtgccgaacggggcccagctcctcgcgagaagctatcgcgcggagtgcggcgctggagccacagattgcaccaagccgtgcggcctccgaacagggggtntcgcggtagcgtntccgctcctgccggccgcactcgcgtgtctcctccgcccgcgcagctcaccttgcggccgtcgcggtgagccttcagctcatgctatggcgcggctgccggtgtcgccatctccaccggctttcaccccc

SEQ ID NO: 7344 - DNA, 186 bp, Triticum aestivum
  Clone ID: LIB3281-050-P1-K1-H3
cggacgcgtgggcgcaccctgatccgccgtcgtcaccgactccaggaccaggccaccggagccttccaccggtccaattgctttccttttgaccggttggtcctccttataaaagccggcccggtccgaaattctttgactccagatcgggatcctgcggcagttctccgatcgccagatcgatcg

SEQ ID NO: 7345 - DNA, 316 bp, Triticum aestivum
  unsure (1)...(316): unsure at all n locations
  Clone ID: LIB3281-050-P1-K1-H4
gtcgacgcggactcttgggctcactctgatccgtcgccgccacctnctccggcaccatgggacctaagccttccaccgttccattcgcttccctctcaccgcttgctcctcctcataaagtctgccccgttcgaaaatctttgactccagatcggaatcctgcggcagttctccgatcgccagatcgatcgtatggctgccgcggcggcggacccgatggtgcttgggctgggaactagcggctgcgcgaacgggatctgattggtaggaggccgtgttgggagagcaagatgagggggctctgtgatggaagggg

SEQ ID NO: 7346 - DNA, 336 bp, Triticum aestivum
  unsure (1)...(336): unsure at all n locations
  Clone ID: LIB3281-050-P1-K1-H5
cccacgcgtccggactagttctagatcagccaccgcagccaccacgctacctgacaaagaaagacaggtcaacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtnatccgcgacgccgtcacctacaccgagcacg

SEQ ID NO: 7347 - DNA, 160 bp, Triticum aestivum
  Clone ID: LIB3281-050-P1-K1-H6
cccacgcgtccggactcgttttagatgacgcaccgcatccaccagctacatcagaatgaaagacaggtcgcaccccacccactagaagaagagagagaagctagtttacatcggggcgcgtgacgggaaactacctgctctgcaagggccaccccaagcg

SEQ ID NO: 7348 - DNA, 368 bp, Triticum aestivum
  Clone ID: LIB3281-050-P1-K1-H7
agcttcttgtggcagtttttgtgttcgggaatactatgaagacaatttttgaggcaattattttcttattcgtgatgcatcctttcgatgtcggtgaccgctgtgagattgaagaagttcaggttgttgtggaggaaatgaatatcatgacgacagtcttcctacgttatgataacctgaagatctattatccgaacagtgtgctggccaccaagccgatttttaatttctacaggagtcctgatatgggagagggaattgacttctctattcatgttgccacgccggtggaaaaactagctctcatgaaggaaagaatactacgttacattgacggtaagaaggagcattggtaccctggtgcgatg

SEQ ID NO: 7349 - DNA, 346 bp, Triticum aestivum
  Clone ID: LIB3281-050-P1-K1-H8
aagccgtcgcccacgcgttcgcggacgcgtggggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaagcggcggccgcttcagcggc

SEQ ID NO: 7350 - DNA, 344 bp, Triticum aestivum
  Clone ID: LIB3281-050-P1-K1-H9
aggagagggtttttggagaggagactcttgccattcctcgccggccgcatctttgctcacctcgccggccgcttcaatcaatcagtgttgattaatcggcgtcggatccgtcgatctaggagatccatgccaccaagagatggggtctcgtatggagtgcagttcagacgagtcgtcagagctaagtgacactgatatcgatgactatgctgagaaggcgtacacagacctcaagtctggcaagcttgtggcgaggttccgcgccgacaggtttagatgcccgttctgccccgggaagaagaagcaggactaccgctacaatgagctgcttcagcacgcaattg

SEQ ID NO: 7351 - DNA, 374 bp, Triticum aestivum
  unsure (1)...(374): unsure at all n locations
  Clone ID: LIB3281-051-P1-K1-A10
cttcttcttcctcctctgccagatccaatccaccaaccttctccatggctctctccgtggagaagacctcgtcgggccgggagtacaaggtgaaggacctctcccaggccgacttcggccgcctcgagcttgagctcgccgaggtcgagatgcccggcctcatggcctgccgcaccgagttcggcccctcgcagcccttcaagggcgcccggatctccggctccctccacatgaccatccagaccgccgtcctcatcgagaccctcaccgccctcggcgccgaggtccgctggtgctcctgcaacatcttctccacccaggaccacgccgncgncgncatcgcccgcgactccgcggccgtcttcgcctggaag

SEQ ID NO: 7352 - DNA, 264 bp, Triticum aestivum
  Clone ID: LIB3281-051-P1-K1-A11
cttcttcttcctcctttgccagatccaatccaccaacctggtgcatggctctctccgtggagaagaccttgtcgggccgggagtacaaggtgaaggacctctcccaggccgacttctgccgcctcgagcttgagctcgccgaggtcgagatgcccggtctcatggcctgccgcaccgagttcggtcccttgcagccctacaagggcgcccggatcttcggctccctccacatgaccatccagaccgccggtcttatcgagaccc

SEQ ID NO: 7353 - DNA, 411 bp, Triticum aestivum
  Clone ID: LIB3281-051-P1-K1-A12
taggccacttactcatgacatctttccccctaagctctcctgtggggggtactttaacgatcatttgcctcatccccataagccgtcagatttttaataatcatgataactactactttccaagaattctacttttttccacacttctttttaatcttttgcacctactactacatggtctacttaaatgacatactctcacatttgtttccactatttgatcctcaaggttcattttacgtctaatacttaatatgaaattttatcattcaatttctaatttctttattacaatctattttacttattcgtatatgtatattctttctaatacattaatatttcacttactataaaaaatatattcattttttcattattcctctatttaccatatatttatatacttat

SEQ ID NO: 7354 - DNA, 113 bp, Triticum aestivum
  Clone ID: LIB3281-051-P1-K1-A2
gtgttctatcttaaaattatgtcatgatcgatctttacttttcttgaaactaatatttactaatttactaggttttgaaggaggtcagattgtcgatcctgatctgggagagt

SEQ ID NO: 7355 - DNA, 173 bp, Triticum aestivum
  Clone ID: LIB3281-051-P1-K1-A3
ccggggggggggaggcacgcgtccgtccacgagttccacaaacagttaaccgcgcttaatgtttggccaggcgagaagacaaaaccgatgcagctgtttgtggtactcgtggaacagttcgttattgctggttctacaatatgtgttagtctttatattactatattcgctgc

SEQ ID NO: 7356 - DNA, 370 bp, Triticum aestivum
  Clone ID: LIB3281-051-P1-K1-A5
ccgattattcccaaattcggccgctccgtcagccgcggccacactggggctgcggcgtccggggcttaaaagggagtgactggcggttctgctgcaggggaatcgcccatggagggctcccgggggcggaggaagtggggtgtcatacacaaatccatgctagcggtggcacgtgacaatgaatatgcagttgacgcagaatatgcgtggggcggtggcagtgcagatccttttaaaaacatttccttgcatgatgcctgggcgaaccatgacaagaaggaaggcgaatcgcatacaaatggcattaataatgcactgatctcaaggattttcgacagaatttggctcaaatgccctgtttttaagagac

SEQ ID NO: 7357 - DNA, 393 bp, Triticum aestivum
  unsure (1)...(393): unsure at all n locations
  Clone ID: LIB3281-051-P1-K1-A6
ggagttcggccagggcacggtgacgcggctcaccaacgggccgtggaccgacacccactgcagctggtcgcccaagggggactgggtcgtcttctcctctacccgcgagatgccagccagcgcgccggagatggccttcctcgatgcgggctacttcgccgtgtacctggtgaaggttagcgaccccacggtggtggtgcgggtggtacagagctcggcgaccctcgcgggacacgtgaaccaccccattttcagcccggacatgaggagcatcgttttcgcctccgaccttgccgctgtctccaatgagcctatctccatgcctgtcttccttcactccgttaggccctacggagatatcctctncgtcgacctccgcgacaccgatgatat

SEQ ID NO: 7358 - DNA, 373 bp, Triticum aestivum
  unsure (1)...(373): unsure at all n locations
  Clone ID: LIB3281-051-P1-K1-A7
cggacgcgtgggatttggtcctgttgattgtgatggcatccacatcaattcttgtggacatgctgtacatcaagaatgtcatgatcgatatttgttttccttgaaacaaagatatatcaggagactaggttttgaaggaggtcagattgtcgatcctgatctgggagagttgctgtgtccagtgtgtcgcagacttgcaaattccattcttccagcatcaccggatttctctggtataactaggaaggcgatgccaattgctcaaaccatgtctactgaagctgctgcaactatacataatttacagttccctcgcgcactggccctncttggaagtgccagaaaaatttgtggacaaagcacatttctaaaa

SEQ ID NO: 7359 - DNA, 371 bp, Triticum aestivum
  Clone ID: LIB3281-051-P1-K1-A8
gccacgcgtccgctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaact

SEQ ID NO: 7360 - DNA, 282 bp, Triticum aestivum
  Clone ID: LIB3281-051-P1-K1-B10
ctcactctttcttttttgcaaaagccaatacaccaacctggggcggggctttatccgtggagaagacctcgtccggccgagagtacaaggtgaaggacctctcccaggacagcttgggttgactcgagcttgagctccgcgaggtcgagatgcccggcctcatggactgccgtaccgagttcagccccttgcagcccttgaaggtcgcccggatcttcgggtgactgcacatgaccattcagaccgccgaccttatggagacccttaccggactcggcaccg

SEQ ID NO: 7361 - DNA, 378 bp, Triticum aestivum
  Clone ID: LIB3281-051-P1-K1-B11
accactcccttcttctcccagatccatcgacgatgtccgggcgcggcaagggcggcaaggggctgggaaagggcggcgccaagcgccaccggaaggtcctccgcgacaacatccagggtatcaccaagccggcgatccggaggctggccaggaggggcggcgtgaagcgcatctccggcctcatctacgaggagacccgtggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatccgtctagtggagcaacttcctcgtttgctct

SEQ ID NO: 7362 - DNA, 380 bp, Triticum aestivum
  Clone ID: LIB3281-051-P1-K1-B12
aggccacggacgcaggacacctttcccccgatgctcgccggcggcgaggacggcaacggccatctgccgcggccccgcaggccgcggcgcgtcggaggcatgggatctccttcgggccaggcggcctcggctctgccgcaccccgctccgcccccctgcaccgactacgacatggcctacttcaaggcctactcccacatcggcgtccacgaggagatgctcaaggatcatgtgaggactaatacttacagaaatgctatcatgcatcacaaagatctaatttcaggcaaggtcgtattggatgttggctgcggcactggtgttctttctatattttgtgcttttgctggtgccactcgggtctatgcagtcgatgcaag

SEQ ID NO: 7363 - DNA, 167 bp, Triticum aestivum
  unsure (1)...(167): unsure at all n locations
  Clone ID: LIB3281-051-P1-K1-B3
ggggaaggagcactggggggacagtagctagcgttgcgagttccccggccaatggcaatggcgtggtggaagaacggcgccttggtcgccgcggcgaccctcgccgtggccgcggtggtctgcgccggcgtggcggcggcggcgagcaagnttcgacgacgttggtg

SEQ ID NO: 7364 - DNA, 381 bp, Triticum aestivum
  Clone ID: LIB3281-051-P1-K1-B4
cggacgcgtgggtgcctccaaaattaatagctcaagtctctcaacacgcggatggatgatgttgtggagagggccatcgagagggggtttgcattgccaaagttgaaggtggccatcgccttgacctgcctggacctcctgacctttcacaacgctcaaacaggaaacacatgttggaggaggagaccacaagctaattgatgatttggatgagtggatcagaggacgacatgagcaggaccatagcggaccattgcaatgcggcaaatcaaatttcaatactcaacactcttctatgtggattaacgaagggcatgatggatggcaccagcggaaaggtgagcgccggtggagataagcgagaaaaggagtagcgcgagg

SEQ ID NO: 7365 - DNA, 381 bp, Triticum aestivum
  Clone ID: LIB3281-051-P1-K1-B5
gttgagagtctctcgagacagttccttcccggcccgatcccggatcctctccgccggcaacgctcgtcgaagaagtgatgggggaggtgctcggcgtgttcttgtacatagtagatgtaggttcagtttccgttctggtgtgttgggcgtgatgcctaggactggcgatatgccgatgaggagcgcgccgcctgcgcgtacgagcagcgcatggtggctagcggcgatgctttggttggtggcggtggcgtggtgctactcgctgctgcgtgattcatcgtcggcgcatcctccaataagctcggttgctgccatgatttggagaaggattcgtccccttcctctgttgcttcaagctgccatggaggtggatggagcgat

SEQ ID NO: 7366 - DNA, 383 bp, Triticum aestivum
  unsure (1)...(383): unsure at all n locations
  Clone ID: LIB3281-051-P1-K1-B6
cccacgcgtccgaaatggtgctatggccacagcggctactccccagaaggcaattactcgaaatcttgttaaaactagcaaaccagagatgaaaagctatgctaaggaaaggttagaacttcaagttggcgggaaactaaaatctagttctgttaatcttcctccaaggaaagttttgacttcgaatgttggagccaatcgagtcgtggagaacatcagaaagccaaataagcagggcattcaggagaccgttggatctcgagtatttgcatcaaagaatgcaactcctttgcagaccggaagcgcaaagacaagggtaccaaacccgncaccgtcttccccaccacgcagggcattccagtcgccgagcaagccaagcccaa

SEQ ID NO: 7367 - DNA, 208 bp, Triticum aestivum
  Clone ID: LIB3281-051-P1-K1-B7
gagaaagggagagatccatggcggagacggagtaccgctgcttcgtgggcggcctcgcctgggccaccgacgaccacaacctccagcaggccttcagccagtacggcgagatcctcgacgccaagatcaatcaaccaccgggagacgggcaggtcccggggcttccgcttcgtcacgttcggcagcgaggagtcgatgccccaggcca

SEQ ID NO: 7368 - DNA, 232 bp, Triticum aestivum
  Clone ID: LIB3281-051-P1-K1-B8
cggacgcgtgggaaatgagataagaactcaaccattgaagccttcgctcttcatttattgaagcaccgtcgagtctgttacgctatggcatgtccatacaggtatctgcatcttgatttttgctggaggaggtggtcaccgtaatgaagtattgagtgttgacttccacccttctgatatctaccgaattgccagttgtggcatggataatactgttaaaatctggtcaatg

SEQ ID NO: 7369 - DNA, 380 bp, Triticum aestivum
  Clone ID: LIB3281-051-P1-K1-C10
cccacgcgtccgacttagggttctagggtttctccagcagcgccggcgcctccacccgcctacccaaccaccatgacggccgagaccgcgaagcaggcggagctgctccgcgccgtcctggatgagcagaagctcgcggcgcagggagatgagcctgtagttgaggatgatgatgatgaggaagatgaggatgatgatgacgaggatgacaaagacgatgatattgaaggagttgatgcaagtggaagatctaagcagagtaggagtgagaagaagagcaggaaggccatgctgaagcttggcatgaagactatcactggcgtgagccgtgtaactgtcaagaagagcaagaatatcctgtttgtcatctccaagccaga

SEQ ID NO: 7370 - DNA, 380 bp, Triticum aestivum
  Clone ID: LIB3281-051-P1-K1-C11
cccacgcgtccgcccacgcgtccgcggacgcgtgggaaggaacttcagtttgacctcgacaacaatgttcattacttggacattactccattgaaaatagatgttgggaagtacttgctagtttttgagattactcttcaggattcagaacatgaaaccgtttacactactggagggagaaacactgagtctgtcgtcgttacaggactgatcaaagttgacaaggcagaaattggaatttctgataatgatgctgggagcgcggagtctgtcgaaaagttagatctgctgaaagatacaaaagtttctctctctgccaaccatctgcagaagttacgtctatcttttcaactatctacaccacttggacgcacatttaa

SEQ ID NO: 7371 - DNA, 229 bp, Triticum aestivum
  Clone ID: LIB3281-051-P1-K1-C12
cttccggtgcgaaatgagttattgtgatggagcacacccgccaagggttgttatgaaggtgccccgaacaacgtgttgaaaatgtcaacagtaaggatctaggcatcaacatccaggctatcaccacaccttctttccgagtactgaccagaaggcgccatctacatcgcatattccgactaatatagcgagctcacccgtgtccttctcaaaatctttctctaaagct

SEQ ID NO: 7372 - DNA, 119 bp, Triticum aestivum
  Clone ID: LIB3281-051-P1-K1-C3
cggacgcgtgggcgggcgcgggggctgctcatcaacgccggcggcgtcatcgagatgaccgtgttcccgcgcaagcacgccatgcccatgtcctccatggtctacaagaactgggaact

SEQ ID NO: 7373 - DNA, 382 bp, Triticum aestivum
  Clone ID: LIB3281-051-P1-K1-C4
cctgtctcgccctccttgttcacatcatctcccttggctttcccttcgacgcttcgagagagagggagagagagaaggaacgaggaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctcacctctgcctctaggtgatccatgtcgaacttgttctgtgtctggtacaagccgtttgtccgagacgcgagccacggttcatggtgctgcctgcctacat

SEQ ID NO: 7374 - DNA, 279 bp, Triticum aestivum
  Clone ID: LIB3281-051-P1-K1-C5
cgacgtctcgcctcgccctatccgtttcctccgtttcacactctcctccccttccttggtataagtcctcccttgctatttccgcctcacatccgaccacaaatccgcaccccggacgcccccaggaccaccggcagcagcagccatgacgccctccgccgtcgccaacctagccggcgcctccccgctgcccgccttcgcgccgaggcccaggtccaggcccaactcgggcagcccgggcccgttcgggcaccacccgcaccggttgaggggtggctc

SEQ ID NO: 7375 - DNA, 384 bp, Triticum aestivum
  Clone ID: LIB3281-051-P1-K1-C6
tgcgtaccctcccccccaccgccgcgccgcccgcctcggctgaacgacggccgggccctctcggcggcggcgatcgacgatggtggtggccacggaggaaatggcggtctactgcttcgacaccctcgtcgcccactacagcggcgagcagccgccgccgcccgccttcgaggagggcgtccacccactgtttgtcacctggaagaaggctaccaatggttccgagccacgcctaaggggatgcattggaactttggagccccgtcagattgtaagtggcttcaaggattatgcgctgacaagtgccctgagggatcggcgcttttctccgatacagtccaaagagctgccatatttggaatgcacagtttctatattgactga

SEQ ID NO: 7376 - DNA, 195 bp, Triticum aestivum
  unsure (1)...(195): unsure at all n locations
  Clone ID: LIB3281-051-P1-K1-C7
aaggccagcactcaccctcccatccctcctttccgggcggaacccccggcggcgtcgncatggtgaagtactcgagggatccgtccaacccgaccaagtcggccaaggcctgtggcagggttttaagggtccatttaaggaccccacccaggccaggtttggtttttggaaggatgctttgggccagggttaaaa

SEQ ID NO: 7377 - DNA, 206 bp, Triticum aestivum
  Clone ID: LIB3281-051-P1-K1-C8
tcggtctattcacacacacacacacacacacttaatgttacctttttcattgatttggaccgcacgtgaaatctggatcttttaccaagtggatagtgcgctcaggatttggaccgcgcagttcgaagattacaacaatgtggtctccagatctgaggattggtgcaggaacataaagaggacaatggggtgccattaccggccag

SEQ ID NO: 7378 - DNA, 196 bp, Triticum aestivum
  Clone ID: LIB3281-051-P1-K1-C9
cccacgcgtccgcccacgcgtccgagtgcgtccatcgacgctgtgcagagtgccgatttacccagcacaacaaccccggacactctgtggtgtctctaggaacacaaaccccccttgtgttttttctcgcagaaggaggatggtggttcaccactttgctgctaataataaaaaaccggcggtatgttctttcttt

SEQ ID NO: 7379 - DNA, 186 bp, Triticum aestivum
  Clone ID: LIB3281-051-P1-K1-D1
gaactagagatttagcgcaccaggtcaaacaaccgaaaaaccgtctggcctggcctgtataaagagcaagacccttcaaactcgtcttccaaaccaacaattcctatccccatcctcaataaatttaaccttaacaaaccccttccatgtcctaccatccatcttgctgttactactacttacttt

SEQ ID NO: 7380 - DNA, 346 bp, Triticum aestivum
  Clone ID: LIB3281-051-P1-K1-D10
cccacgcgtccgcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaac

SEQ ID NO: 7381 - DNA, 374 bp, Triticum aestivum
  Clone ID: LIB3281-051-P1-K1-D11
cccacgcgtccggacagttcttacttcctccaaatgtgatgggtgagatcaatgaaattcaggcaaaattgaacacatcagctaccgatctttctactagaacatctgaaaattctgtgaagatccaaaaattgctgaatcaagtgcggctagctttgattatcattgcagcagtaatgcttcttctggcatttattggcttcctgttatccatcctcgggctggaattccttgtcaacattttggttgttgttggatggatactagtcaccgggacctttatcctgtgtggagtattccttcttctgcacaatggtgatggtgacacctgtgtttcaatggacgagtgggtcgctcatccaacagaacacact

SEQ ID NO: 7382 - DNA, 382 bp, Triticum aestivum
  Clone ID: LIB3281-051-P1-K1-D12
acgcggacgcgtgggagaaaaacctcatattgtaattgaagagaatggtgcaatgagacgtgcacctgctccaaaaagggttgaggatatgtttgagcaagtgaagtctaagcttcctggggctcccaagtttctcttgtgtattcttgctgagaggaagaactcagatgtttatggtccatggaagcgaaaatgccttcgctgactttgggattgtcactcaatgtgtggccccaacaagggtcaatgaccaatatctgacaaatgttctgctgaagatcaatgcaaaacttggtggaatgaactcactgctacaaattgaaatgtccccaagtatacctcttgtatcaaaggtcccaactctcatcttgggaatggatgt

SEQ ID NO: 7383 - DNA, 383 bp, Triticum aestivum
  Clone ID: LIB3281-051-P1-K1-D2
ctacctttccccactcttctccaacccccggacgcaggtactaccagaagtgatcggaagcctgcagtatgggcaatctgtgctgctgtgttcaagttgaccagtctaccgtggccattaaagagcagtttgggaaggttgacagtgtgctttagccaagatgccacttgctggcttggaactttgggaaacctgttggtgggccatttacacttaaggttgcaccacttggtttgccctttggaaaccaaaccaaaggccaatgtgttggcaattgttgttgcatcgattcagtaccgacttttggttggcaaagaaggtgacgcatactacaaactgaccaacacaagatcccagattcaagcctatgtctttgatgtgat

SEQ ID NO: 7384 - DNA, 384 bp, Triticum aestivum
  Clone ID: LIB3281-051-P1-K1-D3
atcaaggagcagttccccatcctctcctacgccgacttctaccagctcgctggagtcgtcgccgtcgaggtcaccggcgggcctgaggttcccttccacccggggagacaggacaagcccgagcctcctccagaaggccgtcttcctgatgccacccaaggctctgaccacctcaggcaggtgttttccactcagatgggtttgagtgaccaggacattgttgctctttctggtggtcacaccctgggaagatgccacaaggagagatccggctttgagggagcatggaccgccaatcctttgatcttcgacaactcttacttcactgagctcctgagtggagagaaggaaggccttcttcagttgccgaccgacaagaccctc

SEQ ID NO: 7385 - DNA, 228 bp, Triticum aestivum
  Clone ID: LIB3281-051-P1-K1-D4
atcacggagcagtttcccattctatcctacgccgacttttaccagggggggggagaggacgccgtcgtggttaccaagctaactggcgtccccttgaaagtataacataggacatgctctatcgtacttcaggacgcccaagtactactgcaacccaagtgattcccctcgtcaccggggactcaataagacagatgggtttcgagtcgccacaacatagctgctctt

SEQ ID NO: 7386 - DNA, 386 bp, Triticum aestivum
  Clone ID: LIB3281-051-P1-K1-D5
aacgccggctctcccccgctccgcctccctccctcatcctcccccggtccgcgccctccgccgccagatcccttcgagccccccgcgcccccgcgtcgaagatgagggagtgcatctcgatccacatcgggcaggccggaatccaggtcggcaacgcgtgctgggaactttactgcctcgagcacggcatccagcctgacggccagacgaacggtgacaagaccatcggaggtggtgatgacgccttcaacaccttcttcagcgagaccggagccggcaagtacgtgccccgcgcggtcttcgtcgacctcgagcccaccgtgatcgacgaggtccgcaccagcgcctaccgccagctcttccaccccgagcagctcatcagcggg

SEQ ID NO: 7387 - DNA, 321 bp, Triticum aestivum
  unsure (1)...(321): unsure at all n locations
  Clone ID: LIB3281-051-P1-K1-D6
gctgttggtctgtccacgggtcagattaagaccggggctccgtgccgctcagagcgtcttgccaagtacaaccagcttctgaggatcgaggaggagctgggcgatgccgcggtgtacgctggcctaaagttccgggcaccggtggagccttactagatgggatctgaacgagtttttgtgaaaatgggtgggtttaacctccggaatgaactctggttgaagctcttaggattgagcaataatgaatgccgcgcatgttttatgtgaacggaacggatatgtacccncaaacttgctccaattttggtccttgtggatatg

SEQ ID NO: 7388 - DNA, 375 bp, Triticum aestivum
  Clone ID: LIB3281-051-P1-K1-D8
aggagatgaaaaatcagaagtcaaagatgagaagaaacaggactcaaaagaagatgagaagagtttacaggatgaataccttaaggcatattatgaggccctcaagaaaagacaggaggaggaagatgcaaagagaatgcagcaggaaggccaggcattttcttctgaaattcattctgagcggcaggtgggcatgaaagccaaacgtgaggatgagaatggtgaggatgagggtgttgaatgggaagaggagcaacctgcagggaatacatcggaggagccatataagtttgtggatttgaatgctgaggccccagaatctggcgacgacgaggaagatgagattgactgggaagaaagttaaagtacagcggc

SEQ ID NO: 7389 - DNA, 355 bp, Triticum aestivum
  Clone ID: LIB3281-051-P1-K1-D9
gggtttttaccttcccgctccgcctgcccacacgcgcttgcctccagaagcttctagacacttcagtcggaggagcagctcacgccgcgcagcagccatggcgtccaccaaggtccagcgtatcatgacccagcccatcaatctcatcttccggttcctccagagcaaagcgcgcatccagatctgtcttttcgagcagaaggatatgcggatcgagggtcgtatcatcggctttgatgagtacatgaacctggttctcgaggatgctgaggaaatcaacattaagaagaacaccaggaaatcgttgggaaggatactcttgaaaggtgacaacataactctgatgatgaacact

SEQ ID NO: 7390 - DNA, 366 bp, Triticum aestivum
  Clone ID: LIB3281-051-P1-K1-E10
ccacattcaggaagagactagcttttggaaaatcaagaattcatgggtttggtgtttttgcaaaggttgcacacaaggcaggagacatgatgatcgaatacataggggagcttgttaggccaccgatatcagaccttagagagcggcgtatatacaattctttggtgggtgctgggacatacatgttcaggatagatgatgagcgtgttattgacgctacacgagcaggaagcatagcccatttgatcaatcactcatgcgagcctaattgttattcgcgtgtgataagtgttctcggggatgagcatatcatcatttttgcaaagcgggatatagacccatgggaagaggtgacctatgattata

SEQ ID NO: 7391 - DNA, 335 bp, Triticum aestivum
  Clone ID: LIB3281-051-P1-K1-E11
ccgacgcgtaggagcacgtcttcctggacacattcgtgatcggtgagctccggtgtgcttcactccagcgcacaacaccataggtcactctcttgttactacgaacatcctggtacgttgcgccaaatggatcattcctgtacgacatgcggatagctagcattttcatggacgtggacccgtacctgttcatgttcatggcctcccggggatacaaccttatgctgaagtaccgtgaggactttttggtttctttctgatgcaatgctccgcagcggatcgtgtattctgtgcggtatatgacttattgttccaatgtatgagctactcacctg

SEQ ID NO: 7392 - DNA, 340 bp, Triticum aestivum
  Clone ID: LIB3281-051-P1-K1-E12
cccacgcgttcgcggacgcgtggggttggcaatgatggactttttagtcacaaagaaattactgtactgtttgtgccaaacctgtcggaatgcgtaccatctatggatatatggagggacaactggatcgcataccgaaaatcaaagatagaaagggagcagctgattatgaagaaggaaaagagcccaggtgatccaaaggaacagaaacaagttgtagaggagccaagcgatgctaaaagtacgaatgatcaattgaaggagggtgatggtgcttctaaagatggaaaaattggatcctggtatgaaaataaagagggtggttgtgctgccaagaatg

SEQ ID NO: 7393 - DNA, 304 bp, Triticum aestivum
  Clone ID: LIB3281-051-P1-K1-E3
cccacgcgtccggaggtcactcagggccgccgccagtaggagcccgtcgctggcgccgtggtccgacccgtaaccgagcgacctgaactaggatgttacctacgcagacatggcaagggagaccctggtgcagaaggccgtgttcctgatgccacccaagggtctgaccacctaatgcaggtgttttccactcagatgggtttgagtgaccaggacattgttgctttttctggtggtcacaccctgggaagatgccacaaggcgagatccgtctttgagggagcatggaccgcctattctttga

SEQ ID NO: 7394 - DNA, 346 bp, Triticum aestivum
  Clone ID: LIB3281-051-P1-K1-E4
gatttaaatgcgagatagttattttacatctagatgtgaaatagcaaacccgatagaaataatatctcagaaaaattaccgcgttccaaagggggggcgcttcagattgttcatacttacggtagcaaacaaaggcaacaatgctctagaaaaaaccatgcgaatacaacagtaggaccattccaaagtagtttacttagggtggcaaaacacagtatatactctctgtccatctcttccatcagagctggtcttgacctgtaacaacgacgacccactggctggctaaggcgccctcaagctgctcaaggcgctactggctgacagtgatgcggtagattattag

SEQ ID NO: 7395 - DNA, 382 bp, Triticum aestivum
  unsure (1)...(382): unsure at all n locations
  Clone ID: LIB3281-051-P1-K1-E5
acgcccctccccatcgcttggtctcttcctctgcatctcgtcgacactggcgtcgccgtgcaccgctcgatcccgcggccactggcacccccgagcgccgagatcttgactacgaggtgcaccgcccactgcttcttcctcctggaccaccagctggagccgggaagctcttcttcggcggatcgcctcgcttcaccaccgtgggcatcgccggtgccgctgcctcgacctgcaacatnggcgcccccccgacctcttcaagcacgccccgacctcactacaccgagctcgacgccgctgctacccagtacgactacggtgttgacgacccctctctcttgccagagcaaccaggcaagcccccccttgatcaccagatatc

SEQ ID NO: 7396 - DNA, 381 bp, Triticum aestivum
  Clone ID: LIB3281-051-P1-K1-E6
cggacgcgtggggctcgaacgagagcctttcctcccccgcggcggcggcggcgcaggtatcttcaaggtctcgctgataaggggaacacggtggcgtactcctgagaatacgtttgcgtcctccggtagcgggaagaggcaggcaccaccgggatccccttcccctacctcccttaccgccgcctctttttttcttggtggggaggaaaagaaaggaaagccgaggaggagcctcgaggaacttctcggctcggcttcttctccaatccaattcattgcctttccagtgattcccacggcccgcagctagctccaccgtcgcactaccggcaaaagggagatcagactgtgagatggcttccccggagccatcggcgggcg

SEQ ID NO: 7397 - DNA, 200 bp, Triticum aestivum
  Clone ID: LIB3281-051-P1-K1-E7
ctccccatgcagcaccaaccatggggagtttgcgagaagatgattagctctgggtgcttccctgatggggagaaggccggtgagattgtgaccttcttttgcaaggggaagaaggtgacggaggcacattcagtatacctagcagcgtaggaatctgaaccttcttctgcttcgctgctaggtatactgaatgagcctcc

SEQ ID NO: 7398 - DNA, 379 bp, Triticum aestivum; identical to SEQ ID NO: 4440
  Clone ID: LIB3281-051-P1-K1-E8

SEQ ID NO: 7399 - DNA, 376 bp, Triticum aestivum
  Clone ID: LIB3281-051-P1-K1-E9
cccacgcgtccgctcggctgttcgtctccacattattctctccggcggcggcgactcgactctcggcgaggggcggagatgtcctacctactcccgcacctgcactccggctgggcggtggaccaggccatcctcgccgaggaggagcggctggtcatgatccgcttcggccacgactgggacgagacgtgcatgcagatggacgaggtgctgtcaggggtggctgagaccataaagaactttgcggtgatctacctcgtcgacatcacggaggttcctgacttcaacaccatgtacgagctgtatgatccgtcaacggtgatgttcttcttccgcaacaagcacatcatgattgatctcgggacgggaaacaaca

SEQ ID NO: 7400 - DNA, 211 bp, Triticum aestivum
  Clone ID: LIB3281-051-P1-K1-F1
cggacgcgtgggcgcccttttttttttttttttaggaaatagctaagatgggccaggaatattttacaggacaacaaatgatccacagtaaaggacaagatagctcacatgatccgggcaatagcttattacaacttcccacaaatagcgttttaactaagcatgcgatgtttacctcttacatgttgccaatatactggacgtaatcgta

SEQ ID NO: 7401 - DNA, 289 bp, Triticum aestivum
  Clone ID: LIB3281-051-P1-K1-F10
cggacgcgtgggcggacgcgtgggccgacgcgtgggttttttttttttttttttttttaccagaaggcaagcaaaaatttgatttcattgcataagaccaggcgattcatcatatgtgatgcagctaaaatagcgacctgaccatttcgagggccattctagcatgcaaatagaggatcaacaccgaaaaaagaaaaagaaaagggcactccttcaatggcccctggcagcataaatcagggaggatgcggccaccatgggggtggggggggcatacacccacgcccag

SEQ ID NO: 7402 - DNA, 271 bp, Triticum aestivum
  Clone ID: LIB3281-051-P1-K1-F11
ggggttggcttctcctccccttccggttcgggttcgggttctggttcggttcgggtccgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggtgagatcctggacgccaagatcatcaaccaccgcgagacggggaggtcccgcgggttcggct

SEQ ID NO: 7403 - DNA, 377 bp, Triticum aestivum
  Clone ID: LIB3281-051-P1-K1-F12
cgtctcctctctcctttccccaacccaaaccaggagcgccctccctgccccagccgcccgccccctccccacccaggaaaccagccatgaagggggccaaatccaagggcgccgtcaaggccgacaccaagttggcggtgaagagcaagggggcggagaagccggccaccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaac

SEQ ID NO: 7404 - DNA, 381 bp, Triticum aestivum
  Clone ID: LIB3281-051-P1-K1-F2
agcccttcctcttcgacatccgcacgcgcccgcacagcttctcctccacctccggaaccaaggatctgcagatggtcagcctcacgctccgcgtgctcgcccgccccgatgtggaacgccttcctgaaatcttcaccaacctcggcctcgactatgacgacaaggtgctcccctccatcggcaacgaggtgctcaaggccgtcgtcgcccagttcaacgcagaccagcttcttaccgaccgtccccacgtttttggccttgtccgtgaagccctcgtccggcgcgccggcgagttcaacatcgggctcgatgacgtcgccatcacccacctcgcctacgggaacgacttcgcccaggccgttgagaagaagcaggtcgcgc

SEQ ID NO: 7405 - DNA, 378 bp, Triticum aestivum
  Clone ID: LIB3281-051-P1-K1-F3
caagcactttgcctatatgtacaaggagatagagcagtgggatgactcgggagcttttgagaatttccagaacgcaaaatcaaggttctggtctcattaccatggccaaccttctgatataccttaccccaaccctgatctgtacattgatgaggtcgaccatcgttgcgaggtcgaccccgagttggtagctgacctggacaaggtgcgggtaccctttgaggcggacaacgagcccgccgtagctgccaataacaggtgtgcccagaaccagtcagggaactgggacatctatctagaaaagccgacccctgaggtgaacaagtgggaggcggacaactcggcatccaacgcaggttggggagcgagtcaggagcc

SEQ ID NO: 7406 - DNA, 382 bp, Triticum aestivum
  Clone ID: LIB3281-051-P1-K1-F4
ctcgtctgccggtcgggggatcagcaccagcgccgatcgaggggtaggaggaggaggaggacgaggacgaggaggaggcgggtgcgcgcgacatggctgcgccgccggcgagggcccgggccgactacgactacctcatcaagctcctcctcatcggggacagcggtgttggcaagagttgcctccttctgcggttctctgatggctccttcactacgagctttattaccacgatcggtattgactttaagatcagaacaatagagctggatcagaaacgtattaagctacaaatatgggacacagctggtcaagaacgtttccggactattaccactgcgtattaccgtggagccatgggtatcctgctttgttatgacgt

SEQ ID NO: 7407 - DNA, 384 bp, Triticum aestivum
  Clone ID: LIB3281-051-P1-K1-F5
cggacgcgtggggaggcgaagaagggcttcatgcgccggatgttccccttcctcctcgccgtcaacgccttcgtcggcgcctacatgctcgtcaggacctactacaaggactccccggccaagaccgccgacgctgcctctgcaactgccacggcgtccaccgccgtcgagtcccaggagcctgttgccgccgtcgcgcccgtcaagccggtgcttccgccgatccccgaggacgagcagcgccgggtctacaagtggatgctggaggagaagcgcaaggtgaagccgcgcgacgccgcagagaagaagaggcttgacgacgagaaggccctgctcaagcacatcatccgcgccgacaccctcccggtgctctgaaacgagaga

SEQ ID NO: 7408 - DNA, 378 bp, Triticum aestivum
  Clone ID: LIB3281-051-P1-K1-F6
ggcggaggtgggtcaggaggaggtggcagcggcggcggcgggtccggcggtggcggatcgggaggaggcggatcaggcgggcgcgcgcggtgccccatcgacacgctgaagctgggggtgtgcgccaacgtgctcaacgggctgatcaacctgcagctggggacgccgccgaagcagccgtgctgctcgctaatccaggggctcgccgacctggaggcggcggtgtgcctctgcacggcgctcaaggccaacatcctgggcatcaacctcaacgtgcccatcgacctcagcctcctcgtcaactactgcggcaagaacgtcccctccggcttccagtgcccccgctagaagagaagacccgagagatccatcgtccac

SEQ ID NO: 7409 - DNA, 367 bp, Triticum aestivum
  Clone ID: LIB3281-051-P1-K1-F7
cttctcctcgctctctctcacacacacagcgcgccgcgctccaagaacaagaagaagaacccactccaagtcgtccaagggagcatggcggcaatggcggagggggcgggggagccggagctggtgtcgatccccgtgacgccgcggggtctgtccacgccggaggggatgtccacgccgccggttaggaggggaggggcagcgacgagcggcgccgggacgccggtgcgccgggtggtggagggcctgcgcggctacctggaggaggtgggccacctcacgcgcctcaacccgcaggacgcctggctccccatcaccgagagccgcagcggcaacgccagctacgctgcattccactccctcaacg

SEQ ID NO: 7410 - DNA, 329 bp, Triticum aestivum
  Clone ID: LIB3281-051-P1-K1-F8
cgcaaaccgccgctaccgatactcgtcctcctcacgcacgcgcttaatcatcttcttctaccaccttcttgcttccactaccaagagaccgggagccgagcagagctacccaagaacctgtcatcgcccatgtctgtgcaagtggcctcgccggcgacggcaggagagaggaccatggccacgacggcgtggccgtacctggagtacatggcgcagtgggagcggcaggtggagcggcggcagctgttcctccggagctaccacttctcccgcgacgccgaggtctcgacgcgcgcgcgcacgcgctgtgtcgtctgggccggggcgcg

SEQ ID NO: 7411 - DNA, 372 bp, Triticum aestivum
  Clone ID: LIB3281-051-P1-K1-F9
ggattacgtggctaaacatgttgcgccctacaagaaagtccgccgagtagccttcgtcaatgcaataaccaaatcacctgctggaaagatcttgcggcgggagcttgtgcagcaggccatgtccatgggcgcctccaagctttgagatgtaattcgctgtgcaaatgtagaagatctctttggctgtatataaactagatatggcactattcttcatcaaccattggtcaccctgtttccttgtgaacaccgggtgcccttcgcgaaacaaatatttttcagtgaagagggtccgagagaacaggctgatcaaacatgtcttctctaatgacggttaaaagtaatctgctattgatcaattcactcagcttg

SEQ ID NO: 7412 - DNA, 355 bp, Triticum aestivum
  Clone ID: LIB3281-051-P1-K1-G1
ggaccggaactcccgggtgctgatggcaagcatatctgaagactctggtgaagaaacaccactacaggttcgcttgaatggtgttgctaccttcattggaataattggactttctgttgctgttgctgttcttgttgtcctcttggccaggtatttcactgggcatacgtacaatccggatggctctccgcaatatgtgaaaggaaagatgggtgtctgtgagacaatacgtggagttgttaaaatcttcacagtggcggtcacaattgtggttgtggctgttcccgaaggacttctcttggctgtcacattgacgctcgccttttctattgcgcaaaatgttgagggataaagc

SEQ ID NO: 7413 - DNA, 321 bp, Triticum aestivum
  Clone ID: LIB3281-051-P1-K1-G10
cccacgcgtgcgcccacgcgtccgcccacgcgtacgtccacgcgttcgcaaactggccacgaccaacacccacagaccggatccagatcttctttcttcttcgtcggctcaccagggaaggacccggcataccaggggtcgagccgattcttgtgagcgggtacgttcattggtcattactcgatggctcgcgcggacaacgttgacgcgccctatgactgcgcggagcaaggctagtcgaggaaggctggagcattggcgtccgcggccgaagacataaggaggcacgaataggccgttgggtaactgaatatggtcgag

SEQ ID NO: 7414 - DNA, 370 bp, Triticum aestivum
  Clone ID: LIB3281-051-P1-K1-G11
cggacgcgtggggttgctttctccttctccaagtaaactcagtttccacagctccgccgcgccgccgattcgccagccatgccgacggtatgcataaaatggcagaagcaggtatttccaggcatagagattgatactagccagccgcctatggttttcaagacccagttgtacacactgactggtgtaccccctgaacggcaaaaaattatggtgaagggtggaatattgaaggatgacacagattggtcaactttgggacttaaagatggtcaaaagttgatgatgataggtacggctgatgaaattgtgaaagctccagagaaaggccccgtgtttgttgaagatttaccagaagaaagagcaagcg

SEQ ID NO: 7415 - DNA, 317 bp, Triticum aestivum
  Clone ID: LIB3281-051-P1-K1-G12
gcgagccaaacgtgccggaaaagaagctcaccctcgaacccgagcggactcgagccacccccagagcggcggagcagacgaggggggaatcccgatggcggcggtggcgatggacatcgcgaagccctcggcgctgccggcgagcgttgacgacccgtcggcggcgtcggccaagggcagggccggcggcggggagggcctgcgccagtactacctgcagcacatccacgacctgcagctccagatccggaccaagacgcacaacctcaaccgcctcgaggcccagcgcaacgacctcaactctcgagttagaatgc

SEQ ID NO: 7416 - DNA, 122 bp, Triticum aestivum
  Clone ID: LIB3281-051-P1-K1-G2
agcacacgttgtctatcattacaatgcgctagagcagcttaatcaggggggggcttgccaaagttgtgagaacgcacaatctcactcttgggctcattgccctggccgacctggtgcgctac

SEQ ID NO: 7417 - DNA, 340 bp, Triticum aestivum
  Clone ID: LIB3281-051-P1-K1-G3
gagaaaggctcaccgtggaaccaatggaatcgcacagaagcatcactggggggggctatggggatcggcgagcacttagagggcgtgaagcagtactgggcacgcaacttcttctgccttgactacttcaagaagggatacggacgttaccaggccctgcccaagtggtccgacgcccacgtcgaatagttcatcgcctccgaccccgtctactgaccgcagatcaaggccatgagggagtccaggaagtttgtgctcgggggggccatggccggcgccgcgcaccttggcggtgttgacttcaagtacttcaagagcccgtacggtgtcttgctggcga

SEQ ID NO: 7418 - DNA, 380 bp, Triticum aestivum
  Clone ID: LIB3281-051-P1-K1-G4
gagaaaggctcaccgtggaaccgatcgaatcgcagcgaagcagcggcggcggcggcgatggggatcggcgagcactttgagggcgtgaagcagcactgggcgcgcaacttcgccttcctcgactacttcaagaaggtctacggccgcgaccagcccctccccaagtggtccgacgccgacgtcgaagagttcatcgcctccgaccccgtctacggcccgcagctcaaggccctgagggagtccaggaagttcgcgctcggcggggccctggccggcgccgcgcacctcggcggcgttgccttcaagtactccaagagcccgcacggtgtcgtgctggcgaccgggttcggagcgctcactggcgccgtgctcgggtcgga

SEQ ID NO: 7419 - DNA, 370 bp, Triticum aestivum
  Clone ID: LIB3281-051-P1-K1-G5
gctcgggctgtttggtcacctccctcccacacccccaccgcagcagagtcctcgcagacggacttcgcccctcgtgctctgcgcctgagatccccagcccccgtccggcgcccttgccgtatttccatttacccgagttcatataaactaccaggggtgcatctgcagctaccggtatgcagatggtggcggagcgcccttgcatcccagcttgccagcgaatgcttgggtcgagatctggagtttctgcattcggaagggcgctcagtaccagaactggctctgcaagctgtgttaaaactgcatcatttggatcgctcatttctggaagcccgaagaagtttgctggcagggctaagtctcacggagc

SEQ ID NO: 7420 - DNA, 313 bp, Triticum aestivum
  Clone ID: LIB3281-051-P1-K1-G6
ggagagagagggttcgagagtctttcagagagcggatccatacagagagtgcgtagggttttatctccgggcggcggctatgtacatggcagccgcaggccagggcggaggcgcgggccccattcagagcggcggcgcgctatgtacacaccaagctgtgcatctgcggcaaggagcataaagaggaggagagggccgcccagacgtctacatgaaaacaatggccaggagcaggagcagaagctcgtacgcaagcaagggcccagaactgcagagcaggctctgcacgccctaagcgcagtagcataatgac

SEQ ID NO: 7421 - DNA, 285 bp, Triticum aestivum
  Clone ID: LIB3281-051-P1-K1-G7
gtctctccacaccgtctgtgggagtagggagtaccgctcctaataattgatccttcgctctccattccctcgttgatttgttgttactctaaagatcaccaccaaccaccctcccctcccccaaaccctcctcccaaccacaatccaatcttttatcaagaacaaattaaccacccctcaccctttaccccaaaacaatcgtctaatctttggtctttgcctccacattgctcccaaatccaaacgtttcggccctggcggcccttaaatccacccttttttcgc

SEQ ID NO: 7422 - DNA, 369 bp, Triticum aestivum
  Clone ID: LIB3281-051-P1-K1-G8
cttatcccatttcttcctctttcctctccctctctctctctcttacacaagttgctgctgagttggtgctgtccttgttcctggacggacacatcctacatgtcgacggcggtggcgcggccctacggcggcggcttccccggatcggggagggccaagggggacgagctgctcggcaagaagatgagcgacgggttcttcatcgaggaggaggaggaggaggaggaggaggaggcggaggaggtgctcacggagagctcctccatcggcgcgccgtcgccgtcgagctcctccatcggcgaggactcctcgtcggaggttggcggcgacggcgaggacgaggaggtggagagcaagctcaaggaggag

SEQ ID NO: 7423 - DNA, 363 bp, Triticum aestivum
  Clone ID: LIB3281-051-P1-K1-G9
cggacgcgtggggtctaaatcccctcgtaaatgaatttgaccaaatcaaatcgatctccgctttcaaaaatgttcacagtaacactggcatttttggaattcatacatcgactgaagcagcatttgttcctaaagttattgacttggcagccagagaactcacttcccttgctactcctggtcaagttgaccaaacccaactggaacgtgctaaagcatttgcaaaatcagctatcttgaagaacctggaatcaaaggcatcaacaactgaagacatggggcgccaagcattggcatttggtgaaaggaaacctgtggagcagcttcttaaggcttgtgatgctataactctggcagatgtat

SEQ ID NO: 7424 - DNA, 367 bp, Triticum aestivum
  Clone ID: LIB3281-051-P1-K1-H1
caccgcaccctcaaaaccctagcgctcgctccgccccaccaccatgggcggagcgcaggagtccctcgtgtacgccggcgtgatgcgcggccacaacgacgtggtcacggccatcgcgacgcccatcgacaactcgcccttcatcgtcttctcctcccgcgacaagtcgctgctcgtctgggacctcaccaaccccatccaggccacccaggactccagctccgagtacggcgttcccttccgccgccttaccggctacatgttcttaccacatggcagatatctcatctccgacggccagttcgcgctctccggatcctgtgacggtgagcttcgcctttgggacctcttcaccggggtaaccacc

SEQ ID NO: 7425 - DNA, 309 bp, Triticum aestivum
  Clone ID: LIB3281-051-P1-K1-H10
cgccgccagcggtcttatgggcaagtcaagcaagaagtccgcggcccctacagtcgtggcgccggcggccgtccttaccaaggggaaggccgggaagaagcgcgaagtcgatgacgagatcgagaaggctgtaagcgcaaagaaacagaaggctgcgccggcaaaggcggtgcccgggcccaaagaggccgccaagaaggccaagaagcagccgccgcccaagaaggttgagagcagcagctctgaggaggagtcatccgagtccgaggaggaggaggtccctaagaagactgcaaagcctgtcaaaca

SEQ ID NO: 7426 - DNA, 380 bp, Triticum aestivum
  Clone ID: LIB3281-051-P1-K1-H3
caaaaagccaatacccgatttcagtttctatgaccgctctgctcccatttacacacaaccttgacacttgcctacttcaaaggttcttgatgctgatgtgacagacagtgttattggtgaaggatgtgttattaaaaactgcaagatacaccattcagtagttggactccggtcctgcatatctgaaggggcaataatagaggacacattgctaatgggtgcggactactatgagactgaagctgataagaaactccttgctgaaaaaggtggcattcccattggtattggaaagaattcacacatcaaaagagcaataattgacaagaatgctcgtattggagataacgtgatgataatcaatgttgacaatgttcaag

SEQ ID NO: 7427 - DNA, 190 bp, Triticum aestivum
  Clone ID: LIB3281-051-P1-K1-H4
acttaccaaaggggaaggcctgggaagaagcagctgaagtttattaaccagatctaaaatgcttgtactcgcaaaataaaccaaaatggtttgcctgtcaacgtcggccaaaggcctgaaacggggactcatagaggccacatagatactacctgcagcacatgttctgagctgcagcttttaagaggag

SEQ ID NO: 7428 - DNA, 333 bp, Triticum aestivum
  Clone ID: LIB3281-051-P1-K1-H5
tcggaacctcgtgggttaacagtgcaaggagctgcctgccagaggaaggacaaaaatggggcttcctgatatggctgcttttcagttactgtggcctcgcctgtattgcatgcgtggctgttggaaagtggctaaaccgaaggcacgcactccgcctgagggcacagcaggggattccggtctctgaatacggggttttggttgacatgattcgtgtgcctgactgggcatttgaggcggtcggcttggaactgagaggaatgggccaggacactgcataccatcctggtctttatctgacagcagcccagagagaagctgtggaggctctta

SEQ ID NO: 7429 - DNA, 410 bp, Triticum aestivum
  Clone ID: LIB3281-051-P1-K1-H6
gcaggtaccgggccgcggttccggggttcgacgcgcatcggcagccaggcgacgcgtccgcccacgcgtccgcaacaacattttggcggcggagatggtcgatggggagatggccccgcctctgatgcagctggagacgctgctagcactcaacatggaccagcgcatggcggagaaccaagctatagaggacggaggcttcttcttgtgtccgtgcgaaagtgaagctgtaccgattggcagtggaaggagcggggaacgggtacatgaagcttggatgtaatctgatttaaactatttttaagggaatgcattacatcacgcagcaagttcagaccaagaaaactggcattctgattctctcaaatctaatggcaaaagttcattgtttactgaagaggcagatgcgc

SEQ ID NO: 7430 - DNA, 366 bp, Triticum aestivum
  Clone ID: LIB3281-051-P1-K1-H7
atatgacatggagattctgttgttactaaaatgtcctgaacttagaggtcattactatagaattttgcaattgaaaagagaaaatggatgtgttctgatcttatcatcttaacacatcacctatttgcattctagtttgaagtagctgggtgtgggtgaagataagagggtgacgatctgacctggtaaattagtggaagcttcagctaccatttgccaatgtgggtttcagttctatatattgttcctaccatgtttgtaccaaatcgaagatatccatttgcagctggattgtgcaaaatcagcagagcatgctcttgttatttttgtccgctcactcggaaactggcaatcctttagctattc

SEQ ID NO: 7431 - DNA, 377 bp, Triticum aestivum
  Clone ID: LIB3281-051-P1-K1-H8
ggtgccaccattctgactgggggtgtcaggcccaagcatctggagaaaggtttcttcattgaacccacaatcatcactgacatcaacacatcaatggagatttggagggaggaagtctttggtccagtcctgtgtgtgaaggaattttctactgaagaggaagccatcgaactggccaatgatactcattatggtctggctggtgccgtgatctccggtgaccgtgagcgatgccagagattagccgaggagatcgacgcgggatgcatctgggtgaactgctcgcagccttgcttctgccaagctccgtggggcgggaacaagcgcagcggctttgggcgtgagctcggagaaggggggatcgacaactacctgag

SEQ ID NO: 7432 - DNA, 373 bp, Triticum aestivum
  Clone ID: LIB3281-051-P1-K1-H9
acgacttgatgatgctgtaacagagggcggggagtccgccactgcgatggaggcggcagtgggtgcagaggacgtgctgcaccctgtgccagaggaggatgctgagtaccatgacgccgctgaggagcacaaggatacttgattggatctatgcatcgatgtcctgttggatccagcatgtaaaggttctagcagtcgactgttggctgagtgctacctcgtggtttctgctgagcacattagctgtttgttagactttactgttcatgtcgatctgtgcttccactatgttgtatttggtgaacatttgttctctagaacttttgtgcttcttggatatcaaattatatgttgctgatgagacagattgact

SEQ ID NO: 7433 - DNA, 396 bp, Triticum aestivum
  Clone ID: LIB3281-052-P1-K1-A1
gcatctccctcacctccggcgaaaaacacaccagagctcacctctgccctcgcttcctcgcgaaaatgtcgactgaagtggctgccgctgacatcccggtgcctcaggtggaggtagccgccgacgccgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcaccttccggccaacttccggaagatcctgctgacccagatcaagaagctcgtcggcggcggca

SEQ ID NO: 7434 - DNA, 255 bp, Triticum aestivum
  Clone ID: LIB3281-052-P1-K1-A10
ccacgcgtccgcgcaggagaaaggtattgtctccaccgtcgacgccttagagaggaggagctaccagcagtgccttcaacacgcattttatcaaagacccgggtatgcggtggtttaccactcgccggacgactgtcagcaggccccgtactacccttcgcaggatcaataaacatcgacacctgcgttgtaccaaggatactctagtcagggtcagccacagcagccaccgacctactactacccgccctcgac

SEQ ID NO: 7435 - DNA, 393 bp, Triticum aestivum
  Clone ID: LIB3281-052-P1-K1-A11
gcgttggccgtctgcagttccttctaacctcctcctcgatggccgaatccccttctaacctagttctgtcccggccggccggccggccgttggtgtggtggatgcacgcggcacgcccacggctgacccctcctgctccttcgagcttggatccgcgctgcccgcacgcggctcgcccatgccggtagcgcacgccgtgcgcgcccgacgtcgtcgttcactcgtcctggacccttggttttgatcaggatgtctagtgcgccatgtcctatttttctgattagtgcaagcgcccatgttgactgactgaaattttcatgtacagccccagcagtgtcctgtccaccccatcgattaattgattcaagttttgatgcgttctgaattttgcat

SEQ ID NO: 7436 - DNA, 399 bp, Triticum aestivum
  Clone ID: LIB3281-052-P1-K1-A12
cggacgcgtgggcggacgcgtgggaaagagaacagcaacgggaataatctcgcctcctttcctcctccccctccccgtccgcgtgcgatcgacgcggaggcgccgcccgtccccctccgctccgccccgacccgaccccatggccttcatgcgcaccttctccaatgcatcctctggcatgggagttgctcctgatatcagggagacattcctggagcttcagatgaagaaggcatttcgctatgtcatcttcaaaatagaagaaaagcaaaagcaggttgttgtggagaagacgggggctacaactgagagttatgatgatttcctggcttgtctcccagaaaacgactgcagatatgccctttatgattttgactttgttactggggagaatgtgca

SEQ ID NO: 7437 - DNA, 393 bp, Triticum aestivum
  Clone ID: LIB3281-052-P1-K1-A3
cgcgtccgcctgaatcaggcccagagcctcaacggaagcggagagctttatctacaaaagtacccaaagttggggttgaaactggtggatggaaccagtctagctgctgcagtggttgtcaatagtattccccatggcgcggaccaagttgttctttcaggaaacatttccaaggtggcctgagctgtggctgcagctctatgcaagaaaaatatcaaggtgataataacaaacaagcaagactatcatttccttcagcccaaaataccagaagatgcagctgacaaccttttactgtcgaaaaccggtatggccaaggtgtggataatcggagaaggcgcagatgccaccgaacagctcagggcgccgaaaggaacacggttcatcccgtac

SEQ ID NO: 7438 - DNA, 213 bp, Triticum aestivum
  Clone ID: LIB3281-052-P1-K1-A5
cggacgcgtgggtaatcatgtaagctgtaagattagtctgcattgtctctttaagttattgctagtgcttgtagtatctctgtggaactgtaattcttgttgtgtctaaattctgatatcaccttcttggaacaagtggcctgctctccagtcccctatacaaatgagactggcattcaaaaaattgatcctttatcaatttatcttaatttt

SEQ ID NO: 7439 - DNA, 399 bp, Triticum aestivum
  Clone ID: LIB3281-052-P1-K1-A6
gcgaggccagctccagcaatatgagcctgaactctgaagaaggtgtgatgtgcaaagatatatcgcactcgtcgcaatctagtgccccttccctggcccatcccctgagcccatgccgctaccagtgcgtctccacgctcagaggccactcctcctacgtctctggcctcgccgtcgacggcatctcgctctacgtctcctcgtcggacggacacatcaagctgtggccactggacatgagcagcacgaccgtgcaacacgagggctctgttgttgccgccaccaatagctccataaagtgcctcatggccaccagcgatggtctcgtcagcgcccaccaggacggcaagatcagggtgtggcagcaggccggccggcggaaaggcgggagcagccacc

SEQ ID NO: 7440 - DNA, 328 bp, Triticum aestivum
  Clone ID: LIB3281-052-P1-K1-A9
cgcaaccctttgctcgactcaaaaccctcgacaagcgctgtcgacctcgcacggccgccgcaacaatggcgtcccttttcaaggacccgagcaagctgtcggtgtacagggaccggcggttccctgggacgcaggaggagtttgaggcggcgctgctggcgtcgctgacggtgtacgtggggaacatgtccttctacaccacggaggagcaggcctacgagctgttctcccgcgccggcgagataaaaaagatcatcatgggcctcgacaagaacacaaagaccccctgcggcttctgcttcgtactgtactactccagggaagatgc

SEQ ID NO: 7441 - DNA, 164 bp, Triticum aestivum
  Clone ID: LIB3281-052-P1-K1-B1
tcgtggacgcgtgggccgcgccggaccggtgagatccagcccccgccgggcgatcccatggcccccgcggaggcgcggttcctcgtcctggtcctcgacaacgtcgtcgctacagggatcggggggtgcgtggacgccctctaaaatttagatggacgctgctg

SEQ ID NO: 7442 - DNA, 398 bp, Triticum aestivum
  Clone ID: LIB3281-052-P1-K1-B10
cggacgcgtggggccgagctcctcgcgattcccaatccccgcacgcctcctcgccctcctcctccggccccgccgccgccgccgcctcgccacaggctcacggttattcaagatggaacacaaggaggcgggttgccagcagccggagggcccaatcctatgcgttaataactgtggcttctttggcagtgcggcgaccatgaacatgtgctccaagtgccacaaggagatggtcatgaagcaggaacaggccaagctggctgcctcctccttcgatagcatcgtcaacggtggcgacggtgggaaagcacctgttgttgcggctgtagccgcgagcgcagaggtggtggttgctcaagttgacgtgaaggcgctcgttgtgcagcctgctgctgatg

SEQ ID NO: 7443 - DNA, 397 bp, Triticum aestivum
  Clone ID: LIB3281-052-P1-K1-B11
ccaccattcttctgttgccctgattgattgtttcttgtggacgccatggccgcccacggtaagcccaagcccaagccgcccggtgcccccgcgccgtcgtcgtccccaccaccgtcgtcgacggcggcagaggcgaagaagggcttcatgcgccggatgttccccttcctcctcgccgtcaacgccttcgtcggcgcctacgtgctcgtcaggacctactacaaggactccccggccaagaccgccgactctgcttccgccactgcaacggcgtccacatcgtctgccgccgccgccgccgagtccactgacccgtcggtggcaacgcccgccaaggtgctcccgccgatccccgaggacgagcagcgccgggtctacaagtggatgctggaggaga

SEQ ID NO: 7444 - DNA, 391 bp, Triticum aestivum
  Clone ID: LIB3281-052-P1-K1-B12
cggacgcgtgggcggacgcgtgggcggacgcgtgggcggacgcgtgggcggacgcgtgggatcccaatgacccatcaattgattccagcaccactacgaccacaacaacttccctaagcatgggtgaccaaagtgtcgcgagcatcgactcggatgggctgacgccgagcgcggtgttctcacagatcatgaaccccaaggggcggtgaggtaaaaatctgggtctgcttttcagtcagtcaccgttggggcctgcctaatttattcattcagcatattttcatgcgtttgtgctcttgctgtctcgcaagttatgcattagaagtcaaaaaattgttccatattagatatttctgtcttgccttgtttttttttcttcttcctcttcttc

SEQ ID NO: 7445 - DNA, 361 bp, Triticum aestivum
  Clone ID: LIB3281-052-P1-K1-B2
cacggtctaatccgattcaaacgcaccgctttctcgtgtccgaactaagccccaatcccgtcaccaccgccgctggtgctcggcgcgatggcgcaaaaggacgccgccaatggcaacggggccaccacgcgcccggcagccacttccttccccattcggttctccaagttctttcaggccaacatgcggatcctggtcaccggcggagctggcttcatcggctcgcacctcgtcgacaagctcatggagaacgagaagaacgaggtcattgttgctgacaactttttcactgggtcaaaagacaacctgaagaagtggatcggacaccctagatttgaactcattcgtcacgatgtcaccg

SEQ ID NO: 7446 - DNA, 401 bp, Triticum aestivum
  Clone ID: LIB3281-052-P1-K1-B3
caacagaggtgataaaaaggcagaagaaagatgataggaaggcaatggaggaagctttgattgaggacattccaaagatgatcagctccatggtgaagtcaggcctcgatatctccgtggatctggacaagctcacccgtcagcctgaagcagcgtagagaagcaacaccgctgccggacacctcgacgcggcagctgcaaatcctgcggcacacctgatacccgaggagaacaagtttaactgggtgggatgtgatgattggtttgacacggtagcactagaaccctccgataataacgtgtacactgttgtttggtacactagatggagacattctttttggtgggaacacatgccgttcattcatcaaatccatggacggctaattctcaacaaaaca

SEQ ID NO: 7447 - DNA, 399 bp, Triticum aestivum
  Clone ID: LIB3281-052-P1-K1-B4
ccaacactccgttgctacaatccaagctaccccacctcaagaacttggaaattagactcaaagcagtcctccccaaaggcttccctccaagctatgacttcttttctttggtttcttttcttgatgcttctcctgccttggagtctttcaccctacacgtaaatgagtatgtcatgacacactatcctgttgttggagataatgacgaatgcccgaggcagaagctggacttgtcgcataaccgcctcagacacatgacgatcacgggattctgttcagccaagagcctggttgagctcacggttcacatccttgagagcacacactcgcttgagcgcttgacgctggacacaacctatgactacaataggtgtattcaagggcctggtaccattggca

SEQ ID NO: 7448 - DNA, 397 bp, Triticum aestivum
  Clone ID: LIB3281-052-P1-K1-B5
cggacgcgtgggcggacgcgtgggcggacgcgtgggcttctcctccccttccggttcgggttcgggttctggttcggttcgggtccgagagtagctagcctagtctagggtttccgtagagaggaggaggagaggaagagagagatccatggcggagacggagtaccgttgcttcgtgggcggcctcgcctgggccaccgacgacaacaacctccagcaggccttcagccagtacggtgagatcctcgacgccaagatcatcaacgaccgcgagacggggaggtcccgcgggttcggcttcgtcacgtacggcagcgaggagtcaatgcgccaagccatcgaggagatgaacggcctagagctacacgggcgcaacatcaccgcctactaggcctag

SEQ ID NO: 7449 - DNA, 392 bp, Triticum aestivum
  Clone ID: LIB3281-052-P1-K1-B6
cgccccacgacacaggtggtgtcgcggcgttgggcagtctcggttgcgcggcgtttttcgattacgtcgacgatgcagtgtcttggtttggtctactaggtgatgcccttcggccttgtcggtggcacacaggtgtcgtggtgtcgtctcggctcgtgtgtcctttcgattgcatcccacggcacaggtggtgtcgcggcgttgtgtactctcggatgcgcggcgccttttgattgcatcgatggtacagtgccctggcttagtctcggctgtccaatggcgttcgactactttggcggtgctcttgttgagttgtctgttcttttcctctttgtttctcccccgttttgtgtgttgtatgtgtgtgtcttttttctttatctcttctcctc

SEQ ID NO: 7450 - DNA, 370 bp, Triticum aestivum
  Clone ID: LIB3281-052-P1-K1-B7
gccccaacatgctatgctggttctgccctgtatcgaggaacataggcaacggcgttcgtttccgcacatcgtatgatattccgctatctacaccaccatccaaagcagaaaagcatctggcaatgtcttgagctcttgcattgagagcgtatattgtgggatcaaatccgtgaatcatgccgcaagtgtaaggtacatagcgggagctgaggagcttcaagagtatttcctccaggccccagggatgtatctggagttagaaatcctaatctagctagttattccattatactttttggccagcttgatgagaagaatcaccgatgggcctcaatagatctggagtggcctggctcgcctgtactcatac

SEQ ID NO: 7451 - DNA, 377 bp, Triticum aestivum
  Clone ID: LIB3281-052-P1-K1-B8
cggacgcgtggggtcggcgagtagggctcatcgcagttgaagcagaggccctgacggcggcgctcctgctgctcggccggggacaaccgacggaaggttcgggtggtggccgaagaggtggtcgccgaggctggagggggccggccaggtgatggtgcgggtcgactgggaaggtggccgccccggccggccggttgctgtagcgcctgagcccgctgctcgaaggcccgggcgtagtacatggccgtctggaggtcggggggatcccggagcttgacgtccacgcggatatggtctggtaatccgcccacaaataacttggcgcgctgagtcgcggagacgcccggcgcatggcatgccaaggcctggaagcgggc

SEQ ID NO: 7452 - DNA, 311 bp, Triticum aestivum
  Clone ID: LIB3281-052-P1-K1-C1
cccttccgcgtcctgaggccgcgctggagcgccccgcgcaacccaacggagtatgtcatgcgcgtggtggagcccatacatccacccatctttcccaaagtttacttaggcaagtagcaccaccggtaggacatcgtgaccaacgtgcagatgggcggcggctgtttctcatcaacaacaccttgtactcccacaaggagaaagtccttcgtgagctcatttacaactcgtcagatgcgcttgacaagatccgcctcgtgagcctgactgacaagagcaagctcgactcccgccggagctttttattcatc

SEQ ID NO: 7453 - DNA, 396 bp, Triticum aestivum
  Clone ID: LIB3281-052-P1-K1-C10
cggacgcgtgggtgctgctgcaggaatcacctcatctccatcagcaggcctgtcaagcttcacaccaacatcctccttgtagtcaccgtgaacctccatgagcttccccaggtcgaacttgggggccttcaggatcttcaccttgcggacgtacacgttctggagggggaagatgcctgaggtggccttctcaatctcctttccaatcacctcagggatgaatgtcctcacaaacttctggggcatagacttcaccactgacaagctcatgtttcttgcgaggaagtggcagacactcattgaggctcatgtggatgtgaagaccactgacaactacatgcttcggatgttcgtcattggcttcaccaagagactcccaaaccatgtgaagcgcac

SEQ ID NO: 7454 - DNA, 394 bp, Triticum aestivum
  Clone ID: LIB3281-052-P1-K1-C11
cggacgcgtgggggttcaggtgattctgatggctgctagagcatcccggatagaaaatcaagatgccattgatacggcaatagttgggatgctaggccatccaaaggaggcgcgtgctggtgtgcaagaggcccatttcctgccgttcaaccctactgacaaaagaaccgcgttgacatacattgatggcgacggaaagatgtaccgtgttagcaaaggtgcaccagagcagattctcaacctggcccacaacaagtcagagatcgcacaaaaagtccacgctgtcatcgacaagttcgcgggacgtggacttcggtcacttggtgtagcatatcaggacgtgccagacggaaggaaagagagccagggtagcccgtggcattttgttgctctc

SEQ ID NO: 7455 - DNA, 399 bp, Triticum aestivum
  Clone ID: LIB3281-052-P1-K1-C12
caggttttgagcaactctccatggcggcaggatctccttgccatcggtggccgcgcgaaccagggctccaagagcagcagcaccggtcaaggaagctccttcgtctccagccccggcacccgccacccctcctcgagctaggaggcttgtgagggtgagcagcaaggaggagagggtggtgactggtgcagctgcaaagccaaagaggcacaaggaggattccgaggaggagacgcgcaagctgcgtggggaggtggaggccctgaggaaggaggtggagaggctgcagctgctcaacaccgagctggaatgcaataagagcgacctgacgcaccagctcgcccttgcgcgctgcaccatcacccggcttcaggagcagcatgacatccatcaggcgca

SEQ ID NO: 7456 - DNA, 226 bp, Triticum aestivum
  Clone ID: LIB3281-052-P1-K1-C2
cgcacgcgtagtcaggtcgtagttaagcactcgacgcataccgaagggggaggtttcaggcgagggggaacccatccatacacccatttttcccaaagtttcattcgacaagtaacatgtccgtccggacattgcgactaacttgcatatcggctgcggttttctctcagtaacaacacctgttactccatcaaggagatcttcctacgctagctcaatgtcaact

SEQ ID NO: 7457 - DNA, 185 bp, Triticum aestivum
  Clone ID: LIB3281-052-P1-K1-C3
gggagattgtgtttagtgccatgattgtatactacgactagtcgagtctgcttgtacaaagaggtccatctagtagttctgacatgtcagttttcatgtacagaaatgtgtcaaacaaactgtacttcacttgtctccgggtttgttcggggagttgacataattggtgtgacttgtatactgcc

SEQ ID NO: 7458 - DNA, 400 bp, Triticum aestivum
  Clone ID: LIB3281-052-P1-K1-C5
gaggaaaccctcgatctcttggtctcgcgaacgagaggcggcggcggcggcaagatccaagcacgacgcgccaccacactccgccctcctccggccaaagctccgcccgacaactggaagcgaagcaccgccacgctccggcctgtacctccacgctccgtccctccggcgggggcgacgacgaccgggctcgtcatccccttcttcccggatctcgtctctccctcaaagcatcactcatctccggcgaagacgacggccatagatcatcctcctctttctcatcaagatcaagggacctcctctccttgtttgaggtttgtaccctgaccccaagtgagcagctgtactgaagaacatcgaatgctttgaagtgctctatctatcctgacatcacaag

SEQ ID NO: 7459 - DNA, 401 bp, Triticum aestivum
  Clone ID: LIB3281-052-P1-K1-C6
cccacgcgtccgcggacgttatttgaagaaaggctctgcaaagaagagcagcggaagctcaagctcgatggagaaggtcgagtacgcccagctacgcaccagcgacgccgacagcgaagtgtcggtggctgcatcagggagcaccggcggcaggttgttcagcaacagcgacagcggcatcatggacgcgttcatgggcggcggtgagtactcgggcatgatccacccaaacagcaagttcgggctcgggttcaggaggtacggcaggtccggcgcaccgccgacggggttcgggcactccgggatgggcgggtcgaacgggttctgcgacccggagcacgggttcgccatcgccgtgacggtgaacaagatggcgctggggtccgtcacgcggcgcgtgg

SEQ ID NO: 7460 - DNA, 287 bp, Triticum aestivum
  Clone ID: LIB3281-052-P1-K1-C7
tcggaggcctttattttggcagtgcgggccccgggataccactgggatattttcattccggtcttggggagggggcaagaaacaggctaccggccgggcaaaacaagggcgcttggggcttgtttcgaaatttaccccatcgggttctttcttattcagggatcacaggggaggaaaaagggggacccctctccatgaaggcgctcattcttgtggggggctttgggaccccccttcgggcttttacactctagtttcccaagcccattgttgattttgcccacaag

SEQ ID NO: 7461 - DNA, 396 bp, Triticum aestivum
  Clone ID: LIB3281-052-P1-K1-C8
ggagaatcagcgtccaaaacactcaagagatcgcgagataagcagcaggccgaacggacatggagatggcgcacagagaccacctcctcgccgccatgcacggcgtcctcggcgtcgccgtcctcatcctgtgcctcgctgccgagctgtccgtcctcgtcttccggcgccacgcggcgctgtacctcctccccgtctgcgcgatgatgacgcacctgtggcgctccggccgacgtgcggacatcggcctggtcgacttcgcgtacctgaagccgccccgccggctgcgcgtcaccatcccgggcctgctcgagcacctccgccttatcggctgcttcgacgacggcagcgtctagttcatgtccagggtcgtcgaggacagcggcatgggcgacg

SEQ ID NO: 7462 - DNA, 399 bp, Triticum aestivum
  Clone ID: LIB3281-052-P1-K1-C9
cccacgcgtccgcggacgcgtgggcggcacccacgtcgccgccacggccgctggctcaccggtgcctggcgcaaacctcctgaacttttcgcgaggcgacgcgacgggcaccgcgccgaaagccaagatcgccatttataaggtctgctaccgctctcccgggggctgcccggactgggccatcgtggcggccgtcgacgccgcggtgagcgacggcgtggatatcatctccatgtcgctcggcgcaggcccgacgcccttctacgacgacgtggtggcggtcgccacgttcggcgcggtccgggcgggcgtgttcgtggtcctcgcgggcggtaacgccgggccgaacgcgttcactgtgtccaacgccgcgccgtggatgaccaccgtgggcgcggt

SEQ ID NO: 7463 - DNA, 383 bp, Triticum aestivum
  Clone ID: LIB3281-052-P1-K1-D10
ccacaaacccccgaccgccggggcttatccgctcctcctcagctcagctcagctcgctcccccaaactgccacgccatggaggcggtcgccgccctcgacgcccgcgccctgttctcccctcccaccgccctcccctcctccccctgcccccacctccgcctcgcggcccgtccgcgcgcgctcgctgcctcccccgccttcgtcgccgccacccccaagcagcgctttctgaccccccacccggaccccgccggtggccgcggcaccagggatgtcgtcgcgatggttatcccgttcctgaggggaacagcgtttgagcagccccccccggatttggccttgttcctttacaaaaacaagatccggtacctggggatgtgcc

SEQ ID NO: 7464 - DNA, 395 bp, Triticum aestivum
  Clone ID: LIB3281-052-P1-K1-D11
caccaccagaaccaaatcaggcgagctctcgttgccggatcgccgaccagcgtcagttccccaccgctacagtgccgccagccaccgctgctccattgccttgggtttggttgtggcgtgggctgggaggaaccgcacggtgttgtctgatgcgtgctccattgcactgggaagtttggtcggccgacgccaggtatgagcagctcctgagaaggatggatgcattcatgtgtcgtgtactaaaaccatgacacttagtttggaacagagggagtatgtatgtacggatatcatggtcatgttgcttgggggttcaacctcctttttggaaaaaaaagaggggtgatgccgatgatgatgactgtggctgaaataatcatgtcttgagcaatcaa

SEQ ID NO: 7465 - DNA, 399 bp, Triticum aestivum
  Clone ID: LIB3281-052-P1-K1-D12
cccacgcgtccgggttactcgtgccggtagcttcactcttgcacgtctcttctccccccaccccctccccctctccgatccatcgatccccaggtcctcgcggccgggtcagccatggcggggtcgatccgcgtcaccatggaggtgggcgcagacggcgtcgcgctcatcaccatctgcaacccgccagtcaatgccctgcaccccatcatcatccaggggctcaaggagaagtacgcggaggccgctgatcgcgacgacgtcaaggccatcgtgctcaccggtgctgcggggaaattctgtggaggcttcgatatcaatgtcttcacaaaagttcatgagactggagatgtgtcacttatgcctgatgtatctgttgatcttgtatcaaacatgatg

SEQ ID NO: 7466 - DNA, 374 bp, Triticum aestivum
  unsure (1)...(374): unsure at all n locations
  Clone ID: LIB3281-052-P1-K1-D2
cggacgcgtggggccaaccagagcatcccgcccgctctcgcctcggtgtcgccgccgcccatggccgtcgccaagagcaaggcaggcaagcacgccgccccgctgctcggcaagtacgagctcggccgcctcctcggccgcggcaccttcgccaaggtctaccacgcgcgctccctcgtcggcggcgaggccgtggccatcaaggtgctcgacaagccggagctggccgccacggccggcatggacgcgcgcgtgctcggcgaggtctncgncatgcgccggctncgccaccccaacgtgctgcgcctccacgaggtgctcgccacgcgctccaaggtctacctcgtcatggagctcgcccccggcggcgacct

SEQ ID NO: 7467 - DNA, 390 bp, Triticum aestivum
  Clone ID: LIB3281-052-P1-K1-D3
cggacgcgtggggccgccgccgtcgagcactcgagcgcagcggagcggaccacagccggtgctagggcttcggttcgagggaggatggggaagtcgaagagcaagggcgccaagttcgccgccgtgaagaagatcatcagcaagaagaccatcaagaagtacaaggacgaggtgctggacccgcggaagaagcacaccgagaaggagaagctcggccggaatgtgccgcaagtgtcgtcggcgctcttcttcagctacaacatggcgctcgggccgccctaccgggtcatcgtcgacaccaacttcatcaatttcttcatccagaacaagtggatttggagaaaggaatgatggactggctttatgcaaaatggaccccctgcatcactg

SEQ ID NO: 7468 - DNA, 401 bp, Triticum aestivum
  Clone ID: LIB3281-052-P1-K1-D4
cggacgcgtgggcggacgcgtgggcggacgcgtgggcggacgcgtggggaagccgcccatcttgctcagttccagctcaggcgagcagcgaccaccttccggcgagggcagcagcgatggagggcaaggaggaggacgtgcggctcggggcgaacaagtactcggagcggcagcccatcggcacggcggcgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccagcgtcggcatccagggcatcgcctggtcc

SEQ ID NO: 7469 - DNA, 399 bp, Triticum aestivum
  Clone ID: LIB3281-052-P1-K1-D5
cggacgcgtgggcggacgcgtgggcggtgcgcctgggtgactccgaccaccggcattgagagcgcgctggacagcgggaactgtcgcgtcaaggaggacgccatggacggcggatcctgggcgctgcacgttgctgccggccacgggaggatgccataccctttgggcgcaacaaactcttggccatagcctcttccgcttttcacaacaaggaaagagatgcatatgagaggaagagagccttccccaagctctgtctaggcgatgcatgggaaatttggaaatttggaaactatcaaggagatgtcgaatgatgaatatactcagatactgagacacattctaaaacgtgtttacgcaggtgatggggctgctgccaacttgggcccgctcaagaac

SEQ ID NO: 7470 - DNA, 400 bp, Triticum aestivum
  Clone ID: LIB3281-052-P1-K1-D6
gaattatggattacaaagagaagcctgattatggtcgttgtgttgcaatggtggcctctgcatccttgagggaaatgataaagccaggggctttagcaattttgtctcccatggccgttggcatcatctttcggattttgggccatgctacggggcagcctctccttggagctaaagttgtcgcctctatgctcatgtttgcgaccgttactggtatcctcatggcactcttcctgaacacttccggcggtgcctgggataatgctaagaagtacatcgagactggtgcacttggtggtaaaggcagtgaggctcacaaggctgcaattactggcgatacggttggagatccattcaaagacacggcggggccttcgatccatgttctcatcaagatgct

SEQ ID NO: 7471 - DNA, 350 bp, Triticum aestivum
  Clone ID: LIB3281-052-P1-K1-D7
cgcaggtctgcacattttaccagaacggtgtgtgctcttatggcagccgttgcagatatgaacatgttgaagtttcttctgaatacacccaaccatcaactactgcagcacttgcaccatccaactcttatctgtcatggtgtcctctttgtgagggggaaatagatgtgagcaaccagacacacaaaagtttatcggtatgctctgtgcatcagtctacctggagatttgatgatgaagattgcattccagaggatgggaacagcttgtcatcagcgctaactgcacaaaaccaagcgctccacccacttgctcatctgcccatatgctcttttgccgcagctggaact

SEQ ID NO: 7472 - DNA, 296 bp, Triticum aestivum
  Clone ID: LIB3281-052-P1-K1-D8
gggggtcaacccacgcgtccccgcaagtctgcacattttaccacaacctcgtcttctcttaagagagcctttccagatatgaacatgttaatatctattctgaatacacccaaccatcctctactgcaagaattacaccattcaactcttatttcacatgaccttctctaatgaagaatacaaacatatgttagctaccagacacacaaaagttcatcagtaatttctcgagatcatactacctgccgatttcttgatgaacacacccttgctcaataagggaacagttttgcatc

SEQ ID NO: 7473 - DNA, 375 bp, Triticum aestivum
  Clone ID: LIB3281-052-P1-K1-D9
tccggtacggcagggtcggctcagacccacccgtgagattgcgcgtagggccacattcggatactacgactagtctgagagtgcttgtacaaagaggtatcatctagttattgctgacatgtcacaatttcatgtacagaaatgtatccaacagactatacttaacttgtgtacaggtttggtcggtgagttgacatactaggtgtgccttgtatgctgccatgagccacttcgccgccatgaagagccccagtagggggcgccctctacaggatccaagactacaaaagcctgctttcgtggtcaaagctgttctatagggtcacctaaactcaatgcacagcgcgtagtttataacacgcgggctgggaaaac

SEQ ID NO: 7474 - DNA, 303 bp, Triticum aestivum
  Clone ID: LIB3281-052-P1-K1-E1
tggggttgttggtattcacacggatcagaccatcgactagtcgggggggggtatgttcaacgaagggtcagatctttattagcgaaatttgagtgtcctagcctgccaatgacgtaaaaaaacactacttggcttcgtcctgggcctttgaaaagacatgactacaccatttaatatttcattagtcgttcaaggaacaattgctgagaacatggattttgcaaaggacgagtcacattcatatgctgtcccaatggatatgggtattttccgcagattggaaagccctttggatatcactac

SEQ ID NO: 7475 - DNA, 394 bp, Triticum aestivum
  Clone ID: LIB3281-052-P1-K1-E10
ctttcttctcggcggaggcgaacgacgaaccctagccgcgcgaggaacgccaagatccccaaggccggcgacgatggcggcggttcggtgcgcggcgaggaggctcggcggctctctgctccagcgaacgcaggcggcggtcgcggaggagggacgcctgctcgtgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccataagaaagaggatgactgctgggcggggttcaatgagacgctaaagaggttggacgagcttcaaaaaaagaagaaaccaagtgtcttt

SEQ ID NO: 7476 - DNA, 355 bp, Triticum aestivum
  Clone ID: LIB3281-052-P1-K1-E11
atatttgcagatatttctgcataaactagaatatatttttaatagaggtgattcctttccgtgcatcaacatacatcatgtactattacacatgtctggaaggtctggtcatccatttatttggtcataaagtacttatcaagattatttatttatgcgtgatcacatccacacatgcatagatcgaggacccatagtcttactatctcactgtgccgcgagcccaacgttgaacgacaattggttgtagcagtcgaggttattcccgtagccgatgccgaagatgtcacaatagcgcttgtagaacccgatccgatcggccaccttgtcgttctagccccatgccgcactcgat

SEQ ID NO: 7477 - DNA, 331 bp, Triticum aestivum
  Clone ID: LIB3281-052-P1-K1-E12
gtttgcaagagcggtgtaataggaaactcacctcaaaagtgctctaaaactacacaagggtctacggaatgaacgaatctcagctgaatctgctaaaactttctgtctagccgaatggaactattgtcaccactttgttcttaagaagaatcaatggaaggaaatgagtagagcaacaaaataaagaatctgaggcactgaggtgaaactacttttgaggtgagctcaggtaatgcacatctgccatcaacttcctagcttctaccaggaaagaacaccaaagttttagcagattcagctgagattcgttcattccggagacccttgtgta

SEQ ID NO: 7478 - DNA, 404 bp, Triticum aestivum
  Clone ID: LIB3281-052-P1-K1-E2
caaagatctggagcagctcgaaaagcaacttgattcatccttaaggcacataagatccacaaggacacagcatatgcttgaccagctcactgatctccaaaggaaggaacaaatgctgtgtgaagcgaataagtgccttcgaagaaaactggaggagagcagccagcagatgcagggccaaatgtgggagcagcacgccgccaacttgctcggctacgaccagctgcgacagtccccgcatcagcagcaggcgccacaccacggcggcaacggcttctttcaccccctggacccaaccactgagcctacacttcagatagggtatactcaggagcagataaacaacgcatgcgtggcggcgtcgttcatgccgacatggctgccctgaagatcgacgatccaac

SEQ ID NO: 7479 - DNA, 400 bp, Triticum aestivum
  Clone ID: LIB3281-052-P1-K1-E3
cccacgcgtccgcgcccatcacgcagcaagtagcttagccgccgctccttttcttatccccaacactcccgcgccaagccgtggccacaaacgtcggccggaccacccacacgtcggcgtcggccatgccatgaccgtgtcactccactcctcgcgtcgccattggcccaggtcaccagagaaagagcactggcaaaggccagctatatccgctccggatcggggccctggaaacctgtggagcagaagctccggccatggccatcccatcctcctacttagccgccatctcccccgcatcctgtcactaccagggatctcatcggatcgcgcaaaaagcttcgaaaagcaaaagcatggccctcccgtcgcccgccggcatcgccaagcccaggctcca

SEQ ID NO: 7480 - DNA, 390 bp, Triticum aestivum
  unsure (1)...(390): unsure at all n locations
  Clone ID: LIB3281-052-P1-K1-E4
cccacgcgtccgcggacgcgtggggctggacaccccgggcgccggcgtgccgatgagcgtgttctggctggtgccgcantacgccatccacggcgtggcggaggggttctcgtcggtggggcacatggagttcctgtacgaccaggcgccggagagcatgcgcagcaccgccgccgcgctcttctggctctcggcctccctcggcagctacatgggcacggtgctggtgacggcggtgcagagcgccacgcggggcggcggcgagtggctccaggacaacatcaaccggggcaggctggacgcctactactggctcgtcacctgcctcatggtgctcaaccttggctactacctcgtgtgcttccacttctacaccatgaagccactgga

SEQ ID NO: 7481 - DNA, 400 bp, Triticum aestivum
  Clone ID: LIB3281-052-P1-K1-E5
cggacgcgtgggatgaaatcctggtgacaaagacagtaaatgatgatgatcatacagacgcgcttgggctgattgatcagggcgtggtgttctgcaaatcaattctccatgaatttgctgttaagacaaaagttgatcagcccacttactccgcagatcatccagaaggggtatcacccatgactctgtttgtttcatctgtgttgtttgctgggaacacttatactggtgaagctgcaacatgtaagaaggacgcagagcagaaggctgctcgtgttgcagtcaaatctattttagctacaaagaacacttgtatgcatcaaattgtcagatcaaagaaagagcttatcattgccatcacatcttctgggttcaacaaagaaagaggagttgtaagcca

SEQ ID NO: 7482 - DNA, 397 bp, Triticum aestivum
  Clone ID: LIB3281-052-P1-K1-E6
cggacgcgtggggcactagttgagaaagcaaaatacatctacattgctggctttttccttacggtgtcccctgaatctattcagcttgttgctgagcatgctgctgccaataacaaggttttcttgatgaacctctccgctccctttatctgcgagtttttccgtgatgcccaagagaaggttcttccgtatgcggactatatctttggaaatgaaactgaggcaaggatcttctctaaagtccgagggtgggagactgagaatgtcgaggagatcgctttgaagatctcacaactgcctctggcttctggaaaacaaaagaggattgctgtgattactcaaggtgctgatccagtagttgtggccgaggatgggaaggtgaaaacattccctgtca

SEQ ID NO: 7483 - DNA, 398 bp, Triticum aestivum
  Clone ID: LIB3281-052-P1-K1-E7
cttgttggtattcacacggatcagaccataagttctacacgaggaccacatcgcccaatcatgaatcttcatgagcgaagtttgagtgtcctagcctgccgttatgttgatgaagtaatcattggtgctccatgggacatttcaaaagacatgattacaacatttaatatttcattagtcgttcaaggaacaattgctgagaacatggattttgcaaaggacgagtcacatccatatgctgtcccaatggatatgggtattttccgcagattggaaagccctttggatatcactactagtactattataaggaggatagtttctaaccatgaagcctaccagaagcggaatgaaaagaaggaagccagtgagaagaagtactacgagagtaaaaactt

SEQ ID NO: 7484 - DNA, 398 bp, Triticum aestivum
  Clone ID: LIB3281-052-P1-K1-E8
cggacgcgtgggctctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacaca

SEQ ID NO: 7485 - DNA, 309 bp, Triticum aestivum
  Clone ID: LIB3281-052-P1-K1-E9
cggacgcgtgggatctcatcttccaaacaccagagcgccagatccccatcccctccaccacgatggcccgcacgaagcagacggcccgcaagtccaccggcggcaaggcgcccaggaagcagctggccaccaaggcggcgcgcaagtccgccccggccaccggcggcgtcaagaagccgcacaggttccgccccggcaccgtcgcgctccgggagatccgcaagtaccagaagagcacggagctgctcatccgcaagctccccttccagcgcctcgtccgggagatcgcgcaggacttcaagaccgacc

SEQ ID NO: 7486 - DNA, 397 bp, Triticum aestivum
  Clone ID: LIB3281-052-P1-K1-F1
cggagatcatcctttgcgtaaacgcggccacgacgaggaatggcgagattgaccgaacctgccgacggtgctccttgacgatatcgctggtcggcttctcctctacgacgtggccgagtacatccgcctccgtgctgcgtgcaaggagtggaggaactgcaccgatgatccacgcgcgggaggcggcctggactgccgcttccgcccccgacgctggatcatgctgtccaaccgcaccgagggcgacggccgtcgctttctcaacgactccaccggtgccagcgcatgtgtcgatctcccggagctctcccgccaccaccttgagaccagcaccgagggccttctgctcctgcgcggcaaggcgagccacgctgtgcgcctcttcaacctgctcacc

SEQ ID NO: 7487 - DNA, 383 bp, Triticum aestivum
  Clone ID: LIB3281-052-P1-K1-F10
cggacgcgtgggcactatgttcctggaactagtatgctcaggatcttcaaaggttcaaaaacaaatggatgtctgcttgattgcttcacggtgtatgaggcggaagaagcaagaggcagaaaatgcaggatgtccaagcttaggcgtgatgctccacgtttcatacctgtcccgaagctgtctctgcaccatgcctacgttcctcggcagcccaaagctgacagaatactgatggacagaattatcagggagacgcacgatctggcaggcaacggcatgcagcagagctcatgggaagaacctgggaacctggctagatattctgccaaggaatctgcacagaaagaaaaccgtagctctggaaaacaggctcgtgaggatgt

SEQ ID NO: 7488 - DNA, 343 bp, Triticum aestivum
  Clone ID: LIB3281-052-P1-K1-F11
cggacgcgtggggcaccagtccaaccgcacccgcgccgcgcggggcaaaaacctccccccgcctctccccctccctccctccccacctacgccgcagcccaccatggaccccttcttcgccgccgacgacgccgcggacgagctgccgcgcaccgcctcccacccattcgacgacgccgaggacgacgagggcgccgtcgtggccggggccgacggcggtgccagaatccacaccgactgttgtgatcgccgggaccgacgtttttgctggcaacggcctgcaggaggacgtaggggacgaacagggggacctggcctgcgacggcggcgccgattcggtaca

SEQ ID NO: 7489 - DNA, 348 bp, Triticum aestivum
  Clone ID: LIB3281-052-P1-K1-F12
caccaacctcaccgcgctcctcgacaaggccggctgcaagcgcttggcgcgcctcatcgtctcgtccggggtcgtcaagacgtaccaggcggccatggacaaggggctcaccctcttcgcgcccaccgacgacgccttccaggccaagggcctgccggatctgggcaagctcaccggcgccgacctcgtggcgctgctggagtaccacgcgctgccgcagtacccgcccaaggcgtcgctcaagaccatgaagggcggcatcccgaccctggcctccaccggcaagggcaagtacgacctctccgtggtcgccaagggcgacgacgtgtccatggacaccggcatgga

SEQ ID NO: 7490 - DNA, 400 bp, Triticum aestivum
  Clone ID: LIB3281-052-P1-K1-F2
cagacacagagaataggagcatgaatatgatgcaaacgggcaccagcctcaatgatgaatgtggttctgcatatggccgctttgagcagcataaaagaaatggtacgcatcatggtgtcggcgctgcatatataccttttagctcttgcgcttctgatggtccttcaactaaaagggtgtttggtgtgactttggatgaaccgcaagcttcacaattgtctaaagagaaaggtagccatgtcgtcaagttggccccagatttgcctcctgtaaaccttcctccttctgtccgtgtgatatctcagatggaatttcatcagaatgcggcgcaggatctgtttcctgtgccacctccaacctttacagaatgtgtttacacacagctaaatcttttccctca

SEQ ID NO: 7491 - DNA, 406 bp, Triticum aestivum
  Clone ID: LIB3281-052-P1-K1-F3
agaaatttcctcttcttccccggtgccctagctccagctgccgccttgccgtggcatcgcataggcctcacacccctgagcccccaacccctgtcacgcgcgtcgccgcctccaaccttatcgcggcaccgcggccctgccgtatctcccagccgccgccgccgccgccatcttcgtcattagttttgaagactgatggattatgataactctagaagacacaatcaaagtacttccaaaaagaggactcgtttcaattctgatgatggaaagaggaaacggctaaactacaggcaggatggcggacatatgtcctctcagccaatagaaaccgtttacaggatattgtgcccaggaaaaaagatcggcggtgtcttggggagaggtggtcatgttgttaaggccc

SEQ ID NO: 7492 - DNA, 397 bp, Triticum aestivum
  Clone ID: LIB3281-052-P1-K1-F4
cggacgcgtggggacattctgtgaaaaatatcatgtagagatgatgatacctgaagaattgagaaaagatcagaaaaaaaagtgcttacacttgtcacgctaagccacgaaatatcaatatatatcttctgtaaccgtcatacagattcaacttagctttttgtatatgtatttaaatggggaagcattagagaaaaatgtaagagggttatgcagtgacaaagtgtggttaatcatgtgatgttcaactgatctagtgttgtgattgatgatgattatgacactgtcaattggtagtggattagtagtgatgctgctggtagaaattgctaacaaataatctgtttgtgcagaaacggcgggtcggcaaaaaggccaagggcgcgaaaagcggaaa

SEQ ID NO: 7493 - DNA, 399 bp, Triticum aestivum
  Clone ID: LIB3281-052-P1-K1-F5
gaagaatttgcagatgaatcacgctatcaggtttaggcgtgcacatggccactaataataataaaaattgatatttgatgaagccatcatcatgtcatgtaattacttgtagaacaactatattgttttttggggcggtaaagcggaaacgataggactctgcaactcatgtgagtgttgtttgattatttactttttcaagcgtgtggatgtcgttggcatgtttagtatacgcacgaagatatgcaaagtgtaaaaatggtttcctgggaacgtcatatttttttctcctgggaacgaatgaactgttcgtcagggagcgatcactccaccgaacgtttttgttcgatctgggggaggagctggagcgaacgattcaccccaggcccccatgcaaac

SEQ ID NO: 7494 - DNA, 369 bp, Triticum aestivum
  Clone ID: LIB3281-052-P1-K1-F6
cggacgcgtgggtgcatgcacgcacgcatgatctacaatccatccattgactagtgctctatagctagtcgtatacgttatttgcttcataatttatcatcgctcttgctagttgctaaacttgcatatttctctctgtgtgtgtggtagtaccgtttgtaccacgtactgcttgtcatcgaactggttacggtactctatggaccatggatccagttctcagccacatatgatctcatgcgtgtacccgctggctgctattatatttccttcaaaaagaggttgctcctccacaattgtagtaaagtaattaatatcatatgtcaactgtctctgggtgatctttagcatttgctaatggattcgatt

SEQ ID NO: 7495 - DNA, 396 bp, Triticum aestivum
  Clone ID: LIB3281-052-P1-K1-F7
gaaatcttcaaaaccttgaaatactgaacatgtccagcaacaatcttcatggtttagtgccaaaggagatctttagaattccaacactaagggaaatttatttatctttgaacaacttcaatggacaacttcctaacgacattggtaatgccaaacaactcagaaatctagaactctcttcaaatagtctatctggagatattcctagcactctgggtgagtgtgcaagtttggaagatatcaagttggactggaatgttttcagtggaagcatccccacttcattaagcaaaataagtagcctaaaagttcttagtgtttcccacaataacattactggatcaattccagtgtctcttggcaacctacaatatcttgagcaactagatctgtcat

SEQ ID NO: 7496 - DNA, 397 bp, Triticum aestivum
  Clone ID: LIB3281-052-P1-K1-F8
ctggcggaggcgctcgcgcggattcaggacggctgcatcagccgctacccggcgctctacggcagcgacgaccggatccaggcgtgcatggcggagctgggggtgccgctgaccaagcacccggggttccaccagtacgacgtctacggggacctcctgggcctcctcgcggcgcacccggtggcgccgatcgtgacgctgcaccacctggacgtcgtgcagccgctgttccccaacgcgcccgcgcgccctgcggcggtgcggaggctgttcagcgggcccgtgaagctggacccggcggggataatgcagcagtccatctgctacgacggggcgaaccggtggacggtgtcggtggcgtgggggttcgccgtgctggtgtcgaggggggtgacct

SEQ ID NO: 7497 - DNA, 364 bp, Triticum aestivum
  Clone ID: LIB3281-052-P1-K1-G1
atttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcagatgcggctggtaagaccaccatcctctacaagctcaagctcggagagatcgtcaccaccattcccacaattgggtttaatgtcgaaactgtacagttcaagaacattagtttcaccgtttgggatgtccggggtcaggacaagatc

SEQ ID NO: 7498 - DNA, 260 bp, Triticum aestivum
  Clone ID: LIB3281-052-P1-K1-G10
cggacgcgtgggtttgtccatccaagacctcctcgcgcttgtctactttggctcccttttttatgtcaagtcaccagacgagttcatcaccaccatggttgcacgcaagcacgagcggagcagctgcatcacctacggctatgtatgggatgataccgtggacctgcttacggagaacgaccttgatgcagtgtctgccgtggcggcccttgccacggctcgccctgcttttgggggtggcgtctcccaccatgacgcac

SEQ ID NO: 7499 - DNA, 377 bp, Triticum aestivum
  Clone ID: LIB3281-052-P1-K1-G11
ggcgtgcacgctcgcacctcctcggcggcatcaccccccaccggcgtcgacccggaccagccccggccgcctcctccacctgtcgcgctccgctgttcctgctcgccgtgttcagctcgggcgggcctcgacggtgtcccctcgcgccttcttcggccgcgccgacctcgacggccttctgcagcgcgcttggcggggcgccaacgcgggggccgagcgcctctccttcgaggcgcgacaggccgcgcagcgcctggacgggaggtactcgatctcgcgccgcgtggccgaggccgcgcgcgcggagcgggaacgagccgctgagatcgacgcggaactcggcgtcggccggcgatgagcggtctttttcgtcgact

SEQ ID NO: 7500 - DNA, 373 bp, Triticum aestivum
  unsure (1)...(373): unsure at all n locations
  Clone ID: LIB3281-052-P1-K1-G12
cggacgcgtgggcgctgctggcggaggacggggagcggtggcgggtgtaccgcgccgtgcgcggggagctgccgtcggacgacgacgcggccggcatcgacgggttcgtcatctcggggagctgcagcgacgcgcacggcgacgagccctggatcctcgccctcgtcgacctcatccgccgccagctcgccgccggcaagcgcgtcctcggcgtctgcttcggccaccagatcctgtgccgggcgctgggcggcaagaccgggaggtcgtgcaaggggtgggacatcggcgtcagctgcattcaccccaccgncgcggcggtgaggctcttcgcgccgctcaagatgccagtgcacctgcccatcatcgagtt

SEQ ID NO: 7501 - DNA, 392 bp, Triticum aestivum
  Clone ID: LIB3281-052-P1-K1-G2
catcgtcactccaatccagcgaccgcctcgcccagatcgccgccgattagatccggttcctcgacgggatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcatccatccccaccataaagtaccttctcgagaagggcgccaaggtcatcctggccagccatctgggccgcccaaaaggtgtcacccccaagttcagcttgaagcctcttgttccacgcttgtctgagctccttggacttgaagttgtgatggcccctgactgcatcggtgaagaagttgagaaattggctgct

SEQ ID NO: 7502 - DNA, 194 bp, Triticum aestivum
  Clone ID: LIB3281-052-P1-K1-G3
tatccgcagtccaagctagagataatctcttgcagatcgacaccagggggatcctattcttgggccgggaatctatccaaagcgagctggctactctaactgagacgcatcatagaggcaatgcagtatatatacgctctaaccgtagcgcttctgttggtcattcctataaaagactgttggacgcccatatc

SEQ ID NO: 7503 - DNA, 396 bp, Triticum aestivum
  Clone ID: LIB3281-052-P1-K1-G4
gccgggggtgtgatgacagtcttgatcccaaggaacaccaccatcccgaccaagaaggagcaggtcttctccacctactcggacaaccagcctggtgtgctcatccaggtgtatgagggtgagaggaccaggacccgtgacaacaaccttcttggcaagttcgagctgtctggcatccctcctgctcccaggggagttccccagatcacggtctgctttgacatcgacgccaatggtatcctgaacgtgtctgccgaggacaagacgactgggcagaagaacaagatcaccatcaccaacgacaagggcaggctgagcaaggaggagatcgagaagatggtccaggaagctgagaagtacaagtccgaggacgaggagcacaagaagaaggtggag

SEQ ID NO: 7504 - DNA, 401 bp, Triticum aestivum
  Clone ID: LIB3281-052-P1-K1-G5
tagagcagagcccggcagaaaagggggtggcgatggcggcggtgctgaaggtgtacgcggaccggctgtcgcagccgtcgcgcgccatcatcatcttgtgcaaggtcaaccggatcgacttccaggagctcaccgtggatctcgccaagggacaacaccgcgcaccagagttcgccaaaatcaaccccatggcgcaggtcccaacaatcgtcgatggaagattcaaactatttgaaagtcatgccattctgaggtatctcgccaccgtcttccccggggttccacatcactggtatccagccgacttatttaccagagcaaaactcgagtccgtattggattggcatcactctaatctgcgccgtggtgcagcaacctatgtactgcacaccgcgttgggt

SEQ ID NO: 7505 - DNA, 396 bp, Triticum aestivum
  Clone ID: LIB3281-052-P1-K1-G7
atctgatcaagaggcaagatcggaggctgatcaaaaacctgcagaaactatcaggcagtgcacagttgtggaatccaatgttaagccagaagagcagcaggctgctgctaatccaggtgtcatttaccgctgcaaaaagtgtcggaggatggtagcaacacaagagtacgtcgtcacgcacgaggtaggcctaggagaggcaggcttcttaaagcgcagaaacgatgcggatgagaagaagcctgaatgcagtgcctgcatcttcgtggagcccatgaagtggatgcaggctgtggaagaggggtacgtttcgaacaagctgtggtgcatgggatgcaagacccggctgggatcgttcgactgggcaggcatgcagtgctgctgcggagcgtgggt

SEQ ID NO: 7506 - DNA, 366 bp, Triticum aestivum
  Clone ID: LIB3281-052-P1-K1-G8
tcgatctgatcaagaggcaagttcttaggctgatcaaaaaccgggggggactattatgcagtgcacagttgtgccatccaatgtttagccacaatagcagcaggctgttgctaatccaggtgttatttaccgctgcaaatagtgtcggaggatggtagcaacacatgagtacgttgtcacgcacgaggtaggtctaggagaggtaggcttcttaaagcgcataaactatgcggatgataagaagcctgaatgcagtgcctgcatcttcgaggagcccatgaagcggatgcaggttgtggaagaggggtacgtttcgaacaagctgtggtgcatgggaagcaagacccggctgtgatcgctttattg

SEQ ID NO: 7507 - DNA, 383 bp, Triticum aestivum
  Clone ID: LIB3281-052-P1-K1-G9
cggagatcatcctttgcgttaacgcggacacgacgaggaatggagggattgaccgaacctgtcgactgtgctctttgacaatatggataggcaacttcttctctacgacgtgggcgagtacatccgcctacatgctgcatgcaaggagtggaagaactgcaccgatgatccacgcgcgggaggctgtctggactgtcgcttccacccctgacgctaagatcatgctagacaaccaaactcgaggcgactgccgtcgctttctcaacctctccaccggagccagtgcatgttttgatcgagaagagctactttgtcaccaactttagaccagaaggcgaggccttctgctcctagccggcaaggcaagccacgctgaacacttc

SEQ ID NO: 7508 - DNA, 247 bp, Triticum aestivum
  Clone ID: LIB3281-052-P1-K1-H1
gtaagccgcggtgtggagtttaacaaatttgaggaagacgtcagcacaggacccgtcctcattctaatgctaagcggtatgaaaaacacatacgctcctaatcaactgcaggttcagcacgaaatggactagtcgtgtgtgggcatatagatagaattgcaacaggtttcttgaaaacgtgagggagatgttcactgaggtttcaaagactgtacctaggtaagcagtagaggtctcccgtggaaca

SEQ ID NO: 7509 - DNA, 389 bp, Triticum aestivum
  Clone ID: LIB3281-052-P1-K1-H10
cggacgcgtggggggcaagatggggttcatcggcgaccaggtggaggcgatccgctcgatgcaggtccgccaggtgctcgcgcagatcatcagcctcggtatgattgttacgtcggcattgatcatatggaaggggttgatggttgcgactgggagtgagtccccggtggtcgtagttctttctggtagcatggagcctggcttcaaaaggggtgatatcctgtttttgcgcatgagtaaagaaccccatccgtactggagaaatagttgtttttaatgttgatggccgtgaaattccaattgttcaccgtgtgattaaggttcatgaacgccaggaaagtgctgaagttgacatcctcacaaaaggggacaacaattttggggatgac

SEQ ID NO: 7510 - DNA, 396 bp, Triticum aestivum
  Clone ID: LIB3281-052-P1-K1-H11
cggacgcgtgggttttttttttttttttttttttttttggggggaaaatcaaagagacatcccgggtaatttattcatccatgagggaggacatacgtacaaaccaacaaaagtaaccagaagcatacaactgtcgactcatcggacattatcagtaccaaacacacacagtccgttcatatctatctgaccggcctcaaatacagatagatcagcagcttatcttcagaggaacctgttgagtaagtcgtcgacggtggtgtacttgacgtcagggtacagtttgctcgcctccacgccaaacgacggcgcgatcttaatgttggtctggtcccccttgatgtacgacgcggggccgatcgaaaagatgatgttcatcgggatcggcgccttttg

SEQ ID NO: 7511 - DNA, 393 bp, Triticum aestivum
  Clone ID: LIB3281-052-P1-K1-H12
cggacgcgtgggcttcaaccgttgatcctgatgctgctggatacgctgaaagagcaaacaaagccaagaagccagtcaagattagtgcccggagccttgcaaagctggacagaaacgaggtgatgaaagctgcagcaaaagctcgggcatcatcctctgttctccgaccaatagatgcccgccatggccatgaagctgatattagctccagtggcaatgccagcgtcaggagtagcatgagcgttgactacagtgctacaaaggaatcaaggagtgagatgaggctgtctcctctacagaactcatatccacagagtcttgcaagccaggatgactatgagactggcacacagactgcaagcagtttaagcagcccggtccacatccacaagc

SEQ ID NO: 7512 - DNA, 371 bp, Triticum aestivum
  Clone ID: LIB3281-052-P1-K1-H2
cggacgcgtgggtccttattgatcagtcaaaccgcagtgggtcgatggaatttattgttcccccggctgatccgtcaacatttttccccatctctattggatttgctgcttccaatactttcagtgatttgaaggtcactggaattcatcctctgaaggaaggcaaccctccaaagtattcacagagggtccgtttggttgctgcgaactatcaaatagtctaaagccataattaaagcagttactgctgtttcttgttagtggcacaaggagtataattttgcatcaaatttgtttaaatatgtgtgatttggcctgtcccatacgtagcgtgtcgcaccattgagaaataaaagcatgaattctcctgt

SEQ ID NO: 7513 - DNA, 399 bp, Triticum aestivum
  Clone ID: LIB3281-052-P1-K1-H3
cttggcaccactgtgaagaatgctgttgtcactgtacctgcatacttcaatgactcgcagaggcaggctaccaaggatgctggtgtcattgctggcatcaatgtcctccgtatcatcaacgagccaacagctgctgccattgcttatggtcttgacaagaaggcttccagtgttggtgagaagaacgtcctcatctttgaccttggaggtggtacctttgatgtctctcttctcaccattgaggagggtatcttcgaggttaaagccacagctggtgacactcatcttggtggtgaggactttgacaacaggatggtcaaccacttcgttcaagagtttaagaggaagaacaagaaggacatcagtggcaacccaagagctcttcggcggctgaggaca

SEQ ID NO: 7514 - DNA, 384 bp, Triticum aestivum
  Clone ID: LIB3281-052-P1-K1-H4
gcattccattggaaaaatcattaataaagcggctaggatgagcggtttcaaacaaaactcggaacctaaaactgacaaagaggtggcgagtcatgctgaatcagctgcacctgcattggagctcgaaggaccaaatgaagttaactccctgaccaacatgccagctatgtcagagccatctgtccttttgtcagaaacaatgcgatccactctttattcctctcttcctattctggcccaaggaaggagctgggttttgctatacagcacatggaggcatggaatatctttgtctactttatatagaaggagtttgctgtgccctggttactcactcctggtagttggggacagaaagggggcgatttttggtggtctagttga

SEQ ID NO: 7515 - DNA, 390 bp, Triticum aestivum
  Clone ID: LIB3281-052-P1-K1-H5
ccacaaatggttcatttactccaagctcacatgttgattttgacccttcaaaatcaaagcgactctcgtggcatccaagatgctcgcttctttttatatggacaaatcccaagtttcttaccttaatttagggtcttcttgtatgaaggttttctctctcacatggagtgtgaccacttagtatctatggcacatggtaagatagggtcatctgtacttgttaatgatggtgctacaaatatttcccagaacaatattgatgcaggcctcatatttagcctggctgatagcaaggtgagcatacatactgctttcatgatattttcatgactggctctttgctaaccatgcagaaatgtagacagagaaaaataaaatttaacaaacctt

SEQ ID NO: 7516 - DNA, 225 bp, Triticum aestivum
  Clone ID: LIB3281-052-P1-K1-H6
cgtgtacagaatctaccactcggctctcatggcggcgaaagaaccgatgcgcgtgctcgtgaccggcgccgcaagacaaatcggatatgctcttgatcccatgatagccagaggagttatgcttggtgcagaccagcctggtattctgcatatgctggatatagaaattgctgctgcagctcttaaaggcgtcaagatggagttgatcgatgccgcattttcact

SEQ ID NO: 7517 - DNA, 386 bp, Triticum aestivum
  Clone ID: LIB3281-052-P1-K1-H7
gcagcgcgtgcgttgctgggagtacaggcagcagccggccatcgtgcgcatcaccaggcccacccgccccgacagggctcgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaagctgggtggtcttcgtgtgctcaactcctactgggtgaatgaggactctacctacaagtactttgaggtcatccttgttgatgttgctcacagtgctgtccgcaatgacccaaggatcaactggc

SEQ ID NO: 7518 - DNA, 323 bp, Triticum aestivum
  Clone ID: LIB3281-052-P1-K1-H8
cccacgcgtccgtacggccgtcgccactccgcctctgccgccgacgagatgggtcgcgtgatccgcgctcagcgtaagggtgcgggctccgttttcaagtcccacacccaccaccgcaagggccccgcccggttcaggtcgctcgacttcggcgagcgcaacgggtaccttaagggcgtcgtcacagatgtcattcacgacccggggcgtggtgcgccgctggccaaggtgaccttcctccacccgttcaggtacaagcaccagaaggagctcttcgtcgccgtcgagggtatgtacaccggccagttcgtgtactgcggacg

SEQ ID NO: 7519 - DNA, 392 bp, Triticum aestivum
  Clone ID: LIB3281-052-P1-K1-H9
cccacgcgtccggagatgtactaacttatactatgcatgtcaggataatgcgttgcttctcaaaaccatgcctagctacaacagcagctattggcgccacagcaccgcgtctggcaggagctcgactctgctggctacctaacaaaaaagtgcctcttcccatcatcatcccctctagaacgccaactcttcttcctcttgacctgctgtttgaggcaacgtgcctgcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagttcctccagaacgccttctccaagtac

SEQ ID NO: 7520 - DNA, 392 bp, Triticum aestivum
  Clone ID: LIB3281-053-P1-K1-A1
cggacgcgtgggtgcccggcagcgcggctatgcaaggacaatacaacaccattgctccatcaggtgtgactcattctgaagggcaatattcatatggaggacctggcatcccaccatctcagccaccaccgcagcacaacatgcaaaggcagcagcttcctcctccaggccaaggctctttcgggccgcctccaggtaaggggggctatcctccgcagtatgcgccgcaggggcatccgcagggttacaacacatcgtatggcagctacccgccgactggtccttctgcagtccaggcagcacagatgcctccagggtcatcgcagcatcacatgatgcgcggccatccatatggagatatgatcgagaaggcaatcaccatgggatattca

SEQ ID NO: 7521 - DNA, 387 bp, Triticum aestivum
  Clone ID: LIB3281-053-P1-K1-A11
cggacgcgtgggcggacgcgtgggcgaacgcgtgggatcgacggagtggtgcgcggcgggcctgcctactgagacgggtggatggagcgcatcatcgaggcgtacagcgcgggcggcttgccgctaacggtcgcggggtcgccgaggctccgcgtgtacgacacggactttgggttcgggcggccggcaaaggtggacgtcgtgtcggtggcgaggaccggcgcgatgtccgtgcagaggcgcgcggcggcggcggcggggtggaggtgggcatctttttgccggcgggtgccatggagcgtttcaacgagtgctttgccgatgccatcgcgtgccttttggcgtaggagtatgtgtaataacggcattgttcttttaagtgcatgc

SEQ ID NO: 7522 - DNA, 366 bp, Triticum aestivum
  Clone ID: LIB3281-053-P1-K1-A12
accacacggagcggcacccgcgagccggcaagagccaccacccgatcttcctcgcctgcggttgcgaagggtcagagatggcgtaccgtgctaaccacccgtctgtcatgcagaagtttggtggacagctgcaccttgccttcagcttctctgagggtggttgcgctcgcaacatctggccttactgtgccatcctatgagaggcgcttcaccacaagctgctacatgactcagaacctaggcatcagtgtccccatgatgtcatcttctgcattgattgccaatgcaccaccttagaagaaagtgtgaaagaacttttcaattgactttcttaaggggggagtgtacggtggagttttcaagact

SEQ ID NO: 7523 - DNA, 352 bp, Triticum aestivum
  Clone ID: LIB3281-053-P1-K1-A2
caatctgccattattatttgtatgtatgtgttcaaaatgaccacctagagattcttgatttgctcctggctgcaccgttgggtttttcgcggctttgtttcgtttgagttctattgttcaaaattgaatttgttgatgcttacagtttggactggtccgtttgatacgtctgcactcgtgatgcggaacattttccaacatagtgtgggttcagaagtgaggaaaacaattggcttgcagggttcaggctactttcttgtgcttgttttgccttgtgattacttgaaactgcaacctgcaggttgaatgggcgctttatattttaaggcggaagactgaagcaatgaaaact

SEQ ID NO: 7524 - DNA, 285 bp, Triticum aestivum
  Clone ID: LIB3281-053-P1-K1-A3
acgtagagacttttatttcgcacacaacgcgcagggggttatccctgctttggccatcacacgggtacatgccacattcgcaccataagagcgaatataaacagcttttggcttgcagggtcgaattgcaatatctacagggacccaccttgtaaagacgccggccttatgagagggttctttggggacttcgtatacatgttggaaacgcctgccccagggccaatctggcttcaactctcaaaagcacgggggccattttcatctgggggtgaagaagaagat

SEQ ID NO: 7525 - DNA, 320 bp, Triticum aestivum
  unsure (1)...(320): unsure at all n locations
  Clone ID: LIB3281-053-P1-K1-A4
cccacgcgtccgccatcgatcccatcgccgccccctcctccctcgatctcgccgccgtcgcgccatggcgaaggcgaagccgtcgtcgtcggcgaagaagcaggcggcgaagagccagggggctcagcagggcggcggggccgggcacgcggcgccgtccgggctcgcgcggtacctcgacccggaggcgccgtgggacaaggaccagctgctggacgcacggcactggatccgccacgccgtggcgctcgcctgcggcctcctctggggngcagnanaagatgaaggggaggattcatttccgaatgttgcgggcaacg

SEQ ID NO: 7526 - DNA, 392 bp, Triticum aestivum
  Clone ID: LIB3281-053-P1-K1-A5
cccacgcgtccgcggacgcgtggggttttttttgggtacttcaatatggactacatacgggctgaaatgtttgaaatcttatattttgtgaatggaggttgtatatttttataaaagcaaagaaacaacttgcataagtgcaccctgtgttaggattaacttgattttaatcttgaaatactgaatgatcggcgatgtaatttcatgtttgcttcaaaatgaggcatcaaagatgaataactctggaatgccaccttttctcatgtatttttccctcaagaaaaagtagtatgaaaatactgattgatccctcttcatcttttcgatgttcttttgcatcttatcaaaaatatgtgcaagtcttcaggggtcaattaatgtttgtaattggc

SEQ ID NO: 7527 - DNA, 385 bp, Triticum aestivum
  unsure (1)...(385): unsure at all n locations
  Clone ID: LIB3281-053-P1-K1-A6
cggacgcgtgggctgattgtgagttgattcctggagggcgtaacattagggtcactgaggagaacaagcatgaatatgtggatagggtagcagagcatcgtttaaccactgcaattaggcctcagattaatgctttcatggaaggatttaatgagctcattcctcgcgagctaatatccatttttaatgacaaagagtttgaactgctaatcagtggactccctgatattgacttggacgacctaaaggcaaataccgagtattctggctacagcatagcttctccagttattcaatggttctgggaaattgtacaaggtttcagcaaggaagacaaagcttgatttcttcagtntcgtactggcacttcaaaagtacctttgga

SEQ ID NO: 7528 - DNA, 248 bp, Triticum aestivum
  Clone ID: LIB3281-053-P1-K1-A8
caatctgccattattatttgtatgtatgtgttcaaaatgaccacctagagattcttgatttgctcctggctgcaccgttgggtttctcgcggctttgtttcgtttgagttctattggtcaaaaatggatttggtgatgcttaaaggttggactggtcccgttgatacctctggactcgcggtggggaacaatttccaacataatgggggttcaaaagtggggcaaaccattggcctggaagggttaag

SEQ ID NO: 7529 - DNA, 272 bp, Triticum aestivum
  Clone ID: LIB3281-053-P1-K1-A9
actagagtacttttatttcacacacacgcgcatactgtaaacacggtggcgggcattaaacggttacaagccacgtaggcttcataagagcgaagataaacagcttttgtcttggagggtcgaattgaaatatttacaggaaaccacagtataaagacgccggcctaatgagagtcttctttcgggactccgtctacatgttggaagcacgggagccaaggcgatgctggcttcagctctcagaagcacgtgggccattttcatcagatgat

SEQ ID NO: 7530 - DNA, 314 bp, Triticum aestivum
  Clone ID: LIB3281-053-P1-K1-B1
cggacgcgtgggcaattcgcacctcccttgcgcccttgccttgttcaccggtcgcctgaccgcatttgagcgatcctcgctccccgttccttcttctacaccttcttccttggtgaagtataagtttatccggccgatcctatccagatatccactccaagctcgtctcttcaatccaaagccacgccctcaaacaagaaagatccaggagaaaccatcgatcgggacatctccagcctagccatatacatggccggcctgtgctctgttcttgcctgagcaccacccctgccgatcaccgagaaacttagaga

SEQ ID NO: 7531 - DNA, 385 bp, Triticum aestivum
  Clone ID: LIB3281-053-P1-K1-B11
cccacgcgtccggacaatcgacagctggctgatcgtgctcatagcagatcctctcgtgaagctgatcagtgcattctcagtgcttttgagagatctgtgaaggagcaggctcgctcaaacgaactcaaggagcgtgagattagtcttagcatgagaaagctgcagctgaaacagactgaattagctcttagctcctcctcgcacatgttagagaagattaagttgtccttgggttttcagaaagcttccttccaaggagagaaattcaagactcagatgcaggacacaaggcatgcagaaattctgaggactcttatagatttccttgttagtgcagtggtaattatgtcagtgtgttttgctatggaacttatgttcactcgta

SEQ ID NO: 7532 - DNA, 277 bp, Triticum aestivum
  Clone ID: LIB3281-053-P1-K1-B12
cggacgcgtgggctctgttgcaaggttcgtgaagcatctttgcgcggggaaaccgagaccgcttggctttgtttatttacctatgtgatgagagccatcaacttttgtgcatgtttaatggagaggagaggccgctccaattgcattttcttgaggaagatgcccaccatacaaagtgcttaacatcacatctatttattgcacgtcaaaaacgaaaatgactatctgataggcaaagcaaacatatcatagcttgttgagcatattcagaatgata

SEQ ID NO: 7533 - DNA, 113 bp, Triticum aestivum
  Clone ID: LIB3281-053-P1-K1-B2
atttaggtgacttgtagctgttaaacaactacctagtatgtatgtctgtgccatgtgttgctgcttcagatgggattaggagctactttattattcagagtgttgtttggtgc

SEQ ID NO: 7534 - DNA, 314 bp, Triticum aestivum
  unsure (1)...(314): unsure at all n locations
  Clone ID: LIB3281-053-P1-K1-B3
ctcaagggtagttgtaggtgttaaacaactacctagtatgaatgggggagggatgnngngaatatttagatggtataatgatctactttattattcaaagtgttgtttgttgcaaaaaataaaaaaaaatataaaaatactccacgnaaggaccagtacagatgggcggtcgttgtataggattcaagcttacattctcttggcttggaatggataacattagtttattgtcacttaaattcaattcattggccttttttttacaatttgttttaatgggaaaacccttggattactcaacataattagtttgc

SEQ ID NO: 7535 - DNA, 393 bp, Triticum aestivum
  Clone ID: LIB3281-053-P1-K1-B4
cccacgcgtccgcgcagaaggtgccggacgaggggtggatcatgaaggacggcacgccgtggcccggcaacaacacccgcgaccaccccggcatgatccaggtcttcctgggccacagcgggggcctcgacaccgagggcaacgagctgccgcgcctcgtctacgtctcccgtgagaagcgccccggcttccagcaccacaagaaggccggcgccatgaacgctctcatccgcgtctccgccgtgctgaccaacgcgcccttcatgctcaacctggactgtgaccattacatcaacaacagcaaggccatccgggagtccatgtgcttcctcatggaccctcaggtcggccgcaaggtctgctacgtgcagttcccccagaggttcgacggca

SEQ ID NO: 7536 - DNA, 393 bp, Triticum aestivum
  Clone ID: LIB3281-053-P1-K1-B5
agaagggcttctacaagaagagctgcccgcaggcggaggacatcgcgcagaaggtggtgtggaagcacgtcgccggcaaccgcgagctcgccgccaagttcctccgcatgttcttccacgactgcttcgtcagggggtgcgatgcgtcggtgcttctggactcgccgaccaacacggcggagaaggatgcgccgccgaacctgtcgctggccgggttcgaggtcatcgacgaggtgaaggcggcgctggagcgggcgtgcccgggggtggtctcgtgcgccgacatagtggcgctggcggcgcgggactcggtgtcgttccagtacgggaagaagctgtgggaggtggagaccgggcggcgggaccgcaccgtgttcagcgacacgcaggcgt

SEQ ID NO: 7537 - DNA, 101 bp, Triticum aestivum
  unsure (1)...(101): unsure at all n locations
  Clone ID: LIB3281-053-P1-K1-B6
cgtagcccccctatagcaaccgcctccctcactccctgcatgccgtgcgcaggctntccttttactccccgccatggctccccgacctcttcctcaagctg

SEQ ID NO: 7538 - DNA, 332 bp, Triticum aestivum
  Clone ID: LIB3281-053-P1-K1-B8
ggaagtacagtgtctggatcggagggtccatcctagcctcactcagcactttccaacagatgtggatatccaaggacgagtacgacgagtctggcccggcgatcgtccacaggaagtgcttctgatctccacgaaacgctgcgccgccgttatcatctagtctcgggttatgtttggttcattcttctagaaatgtattgcgtatttgcaagctatgttttttttccagacgtgacgtgagtactctcgggatatgccgcctatatacgtggcggctccatggtgcaagtgcaagtgcaagtacactatatctatgtttgtgcattgtcaca

SEQ ID NO: 7539 - DNA, 388 bp, Triticum aestivum
  Clone ID: LIB3281-053-P1-K1-B9
cccacgcgtccggcctcggatgaggatccagtgctgcttgcgaacaggcgaccaaataagcagctccccttttgggagctgcagtccccaatcgaagcagcaagagcagcagctcttttgggagcggcgatccgcaatcaagcagctctggtccggcaatccaagcaatcaagcggctcctccccgagccgcagtcggaaatcgaagcaatcaagcggctcctctctgagccgcagtcggaaatcgaagcggctcccttttttagtggctaatccggaatcaaaccagtcctttccggattacaatcagaaacaggccctctttcgaattcagtctccgagtctccattggtggcgaggaccgagaggctatatatgtaaatatctgg

SEQ ID NO: 7540 - DNA, 436 bp, Triticum aestivum
  unsure (1)...(436): unsure at all n locations
  Clone ID: LIB3281-053-P1-K1-C10
nntccgcggacgccgnntgggtctacgaagtacatttagaggcaggcgtgttgaagggtgcgtggtgtttcgcatgatgagaaatcagtctctcattgtctcaacatgagccttaggagaacgagaatttggcccagtcagtcagcattttgtttgcctccacttctgatggnaatattggtggtgtgtcctcagtacctccacatccaagaatctcttttgagaagaagctcatccatgtcataagattgtcggctatgaaggacaaagtctgaatggnggaacctgagatatggttgggatctaatggatctgtcacgagaagatatttcttacttggattcaaagatgcaacgcaaagagggcttggcgttcacgtctatttgcatggcccaaggcgcccagctttcaaagggatctgcccccatcaatcttt

SEQ ID NO: 7541 - DNA, 388 bp, Triticum aestivum
  Clone ID: LIB3281-053-P1-K1-C11
cggacgcgtggggctattttgaaggttctgggcctttggtgtgtggggaaagtgcctcaagaacctaagttgtctgaatggactgaaagagccagcagattcgacaaactgaaatctccggtcaggattgccatggttggaaaatataccggcatatcggattcctacctgtctattttgaaggctcttctgcatgcgtcggttgctttggacaggaaactggtagtggactgggttccttcatgtgatcttgaagattctgctgctgtaaagacgcctgatgcctatgagaaagcatggggtctactaaagggtgcaaacggcgtactagttccgggaggcttttgagacagaggtgtccaaagaaaaattcttgctgcaaaacatg

SEQ ID NO: 7542 - DNA, 365 bp, Triticum aestivum
  Clone ID: LIB3281-053-P1-K1-C12
ggcatgacactaagcatacacggaggagagaagatcggagttgttggtaggactggcagtgggaaatcaacactaatccaggccttgttcagaatagtggagccttccgaggggaagatcatcatcgacggcgtcgacatctgcaccttaggactccatgatctgaggtctcggttcggcatcatccctcaagagcccgtgctctttgaaggtacgatccgaagcaacatcgacccgctcgaggagtactctgatgttgaaatttggcaggccttggaccgttgtcagctgaaagaagccgtgacatcaaaacctgaaaagcttgacgcatcagttgttgacaactgccagaactggagcgtggg

SEQ ID NO: 7543 - DNA, 387 bp, Triticum aestivum
  unsure (1)...(387): unsure at all n locations
  Clone ID: LIB3281-053-P1-K1-C2
cccacgcgtccgggcctgcagggcttcctggtcttcaacgccgtcggcggtggaaccgggtctgggcttgggtcgctcctcctggagcgcctgtccgtggactatggaaagaagtccaagctcgggttcaccgtgtacccatctcctgaggtgtcgacctctgtggttgagccctacaacagtgtgctgtccacccactccctgttggagcacaccgatgtctccatcctgctcgacaacgaggccatctacgacatgtgcaggcgctccctggacatcgagaggcccacctacaccaacctgaaccgnctcgtctctcaggtgatctcatcgctgaccaccttccttgggttcgacggtgccctgaacgtggacgtgaccgagttc

SEQ ID NO: 7544 - DNA, 377 bp, Triticum aestivum
  Clone ID: LIB3281-053-P1-K1-C3
gccagccgctgccgctgccgccctcggtgcccccggcggccatggcgatggagtccctgggcgtgctgctgctgcaccccatgaacgcctacctggagcaggagctcgaccgccgcttccgcctcttccgcttctgggactcccctcccgacggccgcgccgagttcctccgcgccaacgcctccgccatccgcgccgtcgtcggcaacgccagctacaacgccgacgccgcgctcatcgacgcgctgccgtcgctcgagatcgtcgcctccttctccgtggggatcgaccgcgtcgacctccccaagtgcccggagcgcgggatccgcgtcaccaacacccccgacgtcctcaccgacgacgtcgccgacctcgcc

SEQ ID NO: 7545 - DNA, 353 bp, Triticum aestivum
  Clone ID: LIB3281-053-P1-K1-C4
cggacgcgtgggcggacgcgtgggtgccccgccggccggcggaggtgccgaggcgagccgtgccgcgtctgggtcgggggaggcggcggtcggagaaggggccgacgaggaggaggaggacgaggatgaggacgaagaacacgactccgacgacgaagaggacgaggattcggaggatgaaggggacgaggacgaggactaagactccgacgaggagggggacgaccaacgccaagattccgatgacgacgacgaagacgaggactctgatgaggaggaggacgaagacgaggacgatgaatacgaggacgaggacgacgacgacgacgagtaggacgggatggaaatggagc

SEQ ID NO: 7546 - DNA, 342 bp, Triticum aestivum
  Clone ID: LIB3281-053-P1-K1-C5
cctacgcctccctaccccctccccgcccaccgcgacgtcgtccccgttcttcccgaatcccctagtccggtctggaaggtgcagtccgccgtcctctaccctcgtggcgcgtgttgccgggtcggcggcgggggctccgtcgccgttgttcaacccgaggggcgacccgttcctatccacgctagccgctgcttctccagagcagctagcggcagctgcgggtggcgaacgccgcggcgaggaccaccttccgttcctcgagatcttccagaacgccaagctcatgtcctcgcccgcgcaggtggaacgttctagcagctcttacagtcagcacagtcctag

SEQ ID NO: 7547 - DNA, 352 bp, Triticum aestivum
  Clone ID: LIB3281-053-P1-K1-C6
cgtacagctgcagcaacgcccgaggagagcgcagctcgtccccaagcaccggccatccccaagaacgcccgggcctcctcgtcgccggcgagctgtgccttatcgccggaaaaccacctgccgccgtgccctgctcctacccggcaacatcgccgtcgaagtccgtccccgtctcccagatgggatctggctgccgagctcctccacgcggacgggcttcttcgcccccggtcagatctgtcgccgtgtagcccgtttgcgacgggatccaccgaggtgaggtgctgcagccatggctccttctctggccgagcagcagcagcatgaggttaggatggaggatggcaggtgc

SEQ ID NO: 7548 - DNA, 246 bp, Triticum aestivum
  Clone ID: LIB3281-053-P1-K1-C7
ccctgcgcttgctgccactcttcttcgttaacctcccactatccactcacatttcaagcaaacagcttcgacgtccatcgatctcttcgtgcatgagaaacggcatggcggctccgaggttcaggccgatcgaggagtgcgccacggaagggcggtcccggcagacggtcgccgccgacctcgacggcacgctgctcctgtcccggagcgcgttcccctactacctcctcatcgcgctcgaggccg

SEQ ID NO: 7549 - DNA, 224 bp, Triticum aestivum
  Clone ID: LIB3281-053-P1-K1-C8
gcccacctcgggacgctgggcgggctgcggcagcatcacaggccggccagcggcaccggagaggcgttgctcgcatttctacagatcagaacgggggaggaccctgtgctgagcacaggcggcccgaaagaaggggggaagcctggcatggggtgctgccggaggaggcgggtgctatcatgcgctattttgtgggcgccttgtgatgacgcgggcggagctgc

SEQ ID NO: 7550 - DNA, 369 bp, Triticum aestivum
  Clone ID: LIB3281-053-P1-K1-C9
ggccaggacactgagaggatcgaagggagtgctggtgatgtgctggaggatgatcccgtcgggaggctgaaggtgtacgtctacgagctgcccaccaagtacaacaagaagatggtggccaaggactccagatgcctcagccacatgtttgccgccgagatattcatgcaccggttcctgctgtcgagcgctatccggaccatgaacccggaggaggccgactggttctacactccggtgtacaccacctgtgaccttactccgtggggccatcccttgcccttcaagtctccgcggatcatgaggagtgcagttcaattcatctccttgcactggccctactggaaccggacggcgggtgctgatcat

SEQ ID NO: 7551 - DNA, 359 bp, Triticum aestivum
  Clone ID: LIB3281-053-P1-K1-D1
ctatcttgttagtagcgtgatgtagcatttgcctctcgcgtgcggttgataccatctgtaagaaatatttatgctaatccttaacgggtagattgatagttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatcaaagtttacttccgcgtgcttgcaaggtaatagtttttttttggggccccctaaattaaattcactggccggggtttaaaaacgttgggactggaaaaaccctggggttacc

SEQ ID NO: 7552 - DNA, 280 bp, Triticum aestivum
  Clone ID: LIB3281-053-P1-K1-D10
gccacgcgtgcggccacacctacaactactcctccctcggggccgaggcatgttttcaaccgacggtcattattgaggacctccagaatcacattcccatgcgttaaaatcaactagctagcctttacggtatcgcgtctgatagaagtgcttctgggaagcattctgctcaagactagttttgttgagctgttcgacgatcacaacaacgacatgataaacaactaaatagcctacgttttcaaggataacctttttcacgaacagatgcacctccatt

SEQ ID NO: 7553 - DNA, 381 bp, Triticum aestivum
  Clone ID: LIB3281-053-P1-K1-D11
cgcctctccagcaaatatcagtttccgtatatatcgtgtcgccagggccaacacggcggcctagcttaccttgtagttcatccagagaacacacaatggccgtagcgatgccagctgcgcgctcgcttctcctgcttctcctcctggttgcgccgctggcgccgggctcgtcggaggcggcagtccggccgaaccccaagatcgtcaactgggtcgcagacaatgcccgcgcctccacgcccgacagcttcggcgccctcgtcttcgacctctccgtcggcacgccgcggcagaccctctccttcgtcatggacatcaccgagcagctcgtctgggcgcagtgcggccaacatgggttcacgcagtcgcaggcgcccacct

SEQ ID NO: 7554 - DNA, 393 bp, Triticum aestivum
  Clone ID: LIB3281-053-P1-K1-D12
cgcatgtgcagcaaatatcagtttccgtatatatcgtgggggcagggccaacacggcggcctagcttaccttgtagttcatccagagaacacacaatggccgtagcgatgccagctgcgcgctcgcttctcctgcttctcctcctggttgcgccgatggcgccgggctcgtcggaggcggcagtccggccgaaccccaagatcgtcaactgggtcgcagacaatgcccgcgcctccacgcccgacagcttcggcgccctcgtcttggacctctacgtcggcacgcctgggcagaccctttccttcgtcatggacatgaccgagcagctcgtctgggcgcagcgcgtccaacatgggttcacgcagtctcaagcgcctcaccttcaagcccggg

SEQ ID NO: 7555 - DNA, 278 bp, Triticum aestivum
  unsure (1)...(278): unsure at all n locations
  Clone ID: LIB3281-053-P1-K1-D2
cccacactcgcgccccctccctcgcctgccccgccccgctcgcccgcctttccccgcctcgacgactcgccagaccccaccccgacgtcccgcctcgaccgtcccgctcgccgtcttatctccccatcccagccgcgcgccccngccgatcgncgccgactcctactgcgatcgctcgtccctcctcctccacccaaccccaaaccctagcagctcccgctgtcgatgctgtctacttagaccaaactgccggaccgcctccgtacactttcccggcg

SEQ ID NO: 7556 - DNA, 356 bp, Triticum aestivum
  Clone ID: LIB3281-053-P1-K1-D3
ggagaggagaggggagggggagagacgagaaggggaacggaaaagaaagccaagccctctcttgcggaggccaacggcaaggcttcctcccttgcgccctcgcagatcagttcagcggttcggctcctcgggaccattgttggttcgccgaaatggagtcacacagtgatgacttgccaccaccaccaccactcccgccaaatgcagagccgataaaagctgagtcggctgatgacttgccaccaccaccacccctgccgcctatcaaacctgaagaagcaaagaagatctcaaagcctaagagggccctgatcgctcgtcctggttttggcaagaggggaaatcctatacagctt

SEQ ID NO: 7557 - DNA, 392 bp, Triticum aestivum
  Clone ID: LIB3281-053-P1-K1-D5
cggacgcgtggggtgagaacttggcgagagaggagatggggaagggcggcgagctgtgggacgactcggcgctggtggacgccttcgaccacgccgtcgccacctacaaggcaatgcatggcaagaacaaccaaggtgctccatctgagaaacaagagtcagaagatgtagctgctgctgccgcgtacgctgccgctgctgttgcagaagaacctgtctctactgaagtggcagatgagcaaacagagaaaaatgacagctgcactaacttacccattggtccagtggagacaccacagcagccctgtgaggaaagaaataccgataagcaagctcctcttcaagaaactgatctgggcaaagagacaaagatctctgaatctaagacatgc

SEQ ID NO: 7558 - DNA, 355 bp, Triticum aestivum
  Clone ID: LIB3281-053-P1-K1-D6
cggacgcgtggggcaagaccggaaggagcggagccgtcgagccgggaagagccaccaccccatcttcctcgcctccgcttccgaagggtcagagatggcggaccgtgctaaccacccgtctgtcatgcagaagtttggtggacagttccaccttgcctccagcttatgtgagggtgttcgtgctcgcaacatctgcccttctgtgccatcctatgagaggcgcttcaccacaagctgctacatgactcaaaaccttggcatcagcgtccccatgatgtcatcttctccattgtttgccaatgcaccacctgagaagaaaggtgtcaagaactttgcaattgacttactcatggga

SEQ ID NO: 7559 - DNA, 377 bp, Triticum aestivum
  Clone ID: LIB3281-053-P1-K1-D7
ctcaaggaggttcgcgaggaggtcgccaagtacaaggttggcgctcctgctcgtgttgggctagttgcacctgttgatgtggtggttccccctggcaacactggtctggatccctcccagacgtccttcttccaggtgcttaacattcccaccaagattaacaagggtactgtggaaattactatcccagtggagctgatcaagaagggtgacaaggtgggctcctctgagtctgccctgcttgccaagcttggtatccgccccttctcatatggactggtcatctgcaatgtctatgacagtgggtctgtcttcagccctgaggttcttgaccttactgaggaagacctggtggacaagtttgcttctggtggttt

SEQ ID NO: 7560 - DNA, 262 bp, Triticum aestivum
  Clone ID: LIB3281-053-P1-K1-D8
cggacgcgtgggaacagaacaaacacgatatgatatttaaggtatctgacacgctgacacaaacaagatattggacaggaaacagttctgaacttctgatgttccaaaattaggctaacccttcatagtaccagaaagctaaagcttcatgtcagaccttcacttcttggccttcttcggtgccgcagctggagctgcagccgctggtgctggtgcatgatctctgggaccctgggccaatctctcctccctcctggcaatc

SEQ ID NO: 7561 - DNA, 385 bp, Triticum aestivum
  Clone ID: LIB3281-053-P1-K1-D9
cccacgcgtccgcccacgcgtccgcccacgcgttcgcccgagcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgacgttaacgaccccttcatcaccaccgactacatgacctacatgttcaagtatgacactgtccacggacagtggaagcaccatgaagttaaggtgaaggactccaagacccttctcttttgtgagaaggaagttgcggtgtttggctgcaggaacccaaaggagatcccatgggctggtgctggtgctgagta

SEQ ID NO: 7562 - DNA, 236 bp, Triticum aestivum
  unsure (1)...(236): unsure at all n locations
  Clone ID: LIB3281-053-P1-K1-E1
cttccgtgccgatgggccaagccttccttttacttggagggggccaaagggtctttaacttcttgataaagtaacccgaagaaaacaaggtggtacccctgatacaccttggctgggagaccgttgaagttggtgaaatcatatttgtgtgtgtcatgtgtatataaaatctttttctttgtttttatgtggntgtttgcttgtgtaaacttatattaaaaatgtgtcttttgatt

SEQ ID NO: 7563 - DNA, 389 bp, Triticum aestivum
  Clone ID: LIB3281-053-P1-K1-E10
cggacgcgtgggtcagtgggcagaaacatggttatatgagtgatatctggagcttgggcctagttatgctggaatgtgccactggcaatttcccatatcctcctcgtgaaagcttttatgaacttcttgaagctgttgtcgaccaaccatcaccttctgcaccatcagatcagttttcaccagagttttgttcattcatttctgcttgtatccagaaaaatgctgcagataggtcatctgcccaaaccctatcagctcatccattcctgagcatgtacgatgacctgaacatcgatctttctgactacttcacgaccgcaggatcaccacttgccaccttcaagcaaatcgcattgtgagacgacaaatgctcaaccatgcgtcatgag

SEQ ID NO: 7564 - DNA, 260 bp, Triticum aestivum
  Clone ID: LIB3281-053-P1-K1-E11
cggacgcgtgggcggacgcgtgggcacacacacatcatctcccccacctctctcccaaagccaagagctcagagaagcaccggccatggagggcaaggaggaggacgtgcgcctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggca

SEQ ID NO: 7565 - DNA, 375 bp, Triticum aestivum
  Clone ID: LIB3281-053-P1-K1-E2
tgcatatatgccattttcagggagaaaatacaaagatgaaaaacacactgcattgcatttgttcaaggagtgccactacaacaagaagaaagggtacacagatatcgtacaactacaatctgccattttaagtcaaggttcgaggagtgataaccatataacagtgcttacttttttttaatagatccagtagtacaatagtcagtaatttataaagtcagcctaaagaaaggtagaagaataatttgactttgaaacaattgagcacatatcactttaatgaaatgactagattttttctgtactattctttgcttcttacatgaatatgaccacttgacaaccgttgaatgatttatgaaatcttcatatctt

SEQ ID NO: 7566 - DNA, 381 bp, Triticum aestivum
  unsure (1)...(381): unsure at all n locations
  Clone ID: LIB3281-053-P1-K1-E3
ctcggccgttccctcgcctgatcgccccccgtctccgctaccgatggacgccgtcgccttctcccccgctccgaaccccaacgccgcgccattcccctccgcctccccgtcctcgcgcgcccgacgcttctccatccgcggcccgcggcggcggcgcccgctcccggccctccgatccagcgccttccccttcgcctcccaccacgacgtggtcgtcgtgggcgccgggatcgtcggcctctccatcgcccgccacctnctnctncacaccccgctctccgtcgccgtcgccgacgccgccgtcccctgctccggcgccaccggcgcagggcaggggtacgtggggatgtcgcaccggacgcccgggagcgacacgtggga

SEQ ID NO: 7567 - DNA, 396 bp, Triticum aestivum
  unsure (1)...(396): unsure at all n locations
  Clone ID: LIB3281-053-P1-K1-E4
gagatctctctctgcatcgccgccggcgccgttgttctcgccgccgccggctgcgccatgctccgcctccgagagtgcttcgtttcccgtctcctctcttcaccttccacccccacctatgccatcttctctccgccgccgcgccccacatttccccaaatcccagtggcttcgccgtcgaggactacctcgtcgccacctgcggcctcacccgaccccaagccctcaaggcctccaccaagctctcccacctcaagtcccccaccaaccccgacgccgtnctcgccttcctcgccggcctcggcctctccggcgccgacgtcgtcgccaaagatccgctcttcctctgcgccagcgtggggagaaccctggcccctaaggtcgtcgggctaactg

SEQ ID NO: 7568 - DNA, 391 bp, Triticum aestivum
  Clone ID: LIB3281-053-P1-K1-E6
cggacgcgtgggcaagaattcaagatcgagagagcagaccggtcgaccatggcgaggtctggtggccggtgggtcgttgcggcggcgatagtggtgctgctgctgaccacggtgtcatcagcatcagcagcagcaggtgtcgattcagcaacgacggcaccggccaaggtgtggcagctccctccaaggatccctacagagcccttcccggtgccaaagcccccttcttcgtcgtcgtggaaggcggtgaagtcgtttttttcttctcgccaccgcctccctacggaaccgccgtcggaaaagcgtacgtaagatgataatacctactccaactagtaatacatggagggaagtagcaaagtatgcagctgcacaagaatctgcatgcatg

SEQ ID NO: 7569 - DNA, 367 bp, Triticum aestivum
  Clone ID: LIB3281-053-P1-K1-E8
cccacgcgtccgggaagaagaagaagcagagggttttgctacgactacgatggaagaggagaaggcctttcccattgactcgtcaggtttcgagttcttcatcatcatgctctccaagtccttgaagaaactggtacgtacgtttctgggttctacaccgtgatgcttggtcattgggctctgggtttggtactttggtttggttggttcaacacttgttcaattccaactgctgcttgacccacgccacgtcgcagaggatgccagacaagttcgccaaggtgctcgccggacgtgagccccgggaagtgaagctgcgggaggccggcagcgggcgccccaacctgtgggacgtgaaggtggtgct

SEQ ID NO: 7570 - DNA, 371 bp, Triticum aestivum
  Clone ID: LIB3281-053-P1-K1-E9
cggacgcgtgggcggacgcgtgggttctcattgacaggtttctcaagaggaagatgtttgaggatgcagtggacttgttccggtttgcaatgggggggacggagaagccatcggctcaggattttgtcttcttattgaagaagcttgttgtgagggatgatatggatctgaagctggtgatgagtgttgtgcggatctatcagaaggctgggaatgaggtgaagtcttccgtgtttgatgctgttatcaagtcgctgagaagcgtaaaaaggcttggtgagagtggcagggtgttgaaagccatggaggacggtggttttgcaccagacagcactgtgcatggaaaagctggtcttgcaatgtgtgatgct

SEQ ID NO: 7571 - DNA, 277 bp, Triticum aestivum
  Clone ID: LIB3281-053-P1-K1-F1
agaaagggaaccacagcgtgtgagtgagagaggagtgccggggttcgcggcaggcagcgcaccccatgggtagccgcgcgcaaccgcgggcagcatgggagtcagctgcgagtcctttgtgtggcgcctggggtaccgcacgtcgccgcgttagccgcgggggcgttggcagcgtcacgacgcagccgcgggaccatatcgggacccaacagcgtacctgctttttatgaacccccgcttgcgctcctgtggcatgtctatctatctgcgtcgcacg

SEQ ID NO: 7572 - DNA, 394 bp, Triticum aestivum
  Clone ID: LIB3281-053-P1-K1-F10
acccaaccccggcttacccgagcgagcgagaagaggcgatagagcacgggaggcagcaccgctcgggagcaatggagagggcgacgccggtgcggagcccgcacacctcgacggccgacctgctcacgtggtcggcgacgggcgccgacgcctccgccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagaacgagaatagtgattcagagtcttcaaatcctgcaaacagaacttttgtgaggatgta

SEQ ID NO: 7573 - DNA, 341 bp, Triticum aestivum
  Clone ID: LIB3281-053-P1-K1-F11
cccacgcgtccgcccacgcgtccgagcggagcccaaagccaaggagaaatcgctcgctcgaaccctatcctctcctcccctcccctcccctccccgcagccgcaggcacccaaaaccctagcgccgccgcgccggatctttctctgcagctcgcccctcccccccctacctgccggatccatccatccatccatccatgatgggagaggccaaggagaacgacgtgtacgaggaggagctgctcgactacgaggaggacgacgacaaggccctcgacgcctacttcgccaagcccgccgccgacgcccgccaggccaagaagggctacgtcggcatccaca

SEQ ID NO: 7574 - DNA, 388 bp, Triticum aestivum
  Clone ID: LIB3281-053-P1-K1-F12
cccacgcgtccgcccacgcgtccgcggacgcgtggggcgtgtatatgcacacgcccatgattaccatatcaattccatttcaaataatagtgatggcgagacattcatatcagcagatgatctgcgaattaatctgtggaatttggaaatcaacagtcagagctttaacattgttgatgtgaagcctgcaaacatggaggatctaactgaggtgattacatgtgcggagttccatccaactcactgtaatacactagcctatagtagctcaaagggcgctatcaggcttattgacctgcggcaatcagcactgtgtgacaaccattctaaactatttgaggagcatgaagcacctggatcaaaatccttttttacggagataattgca

SEQ ID NO: 7575 - DNA, 385 bp, Triticum aestivum
  unsure (1)...(385): unsure at all n locations
  Clone ID: LIB3281-053-P1-K1-F2
aaataagtatctattttctgttcttgaagtaaggctattaagttgtgctctgaaatgtgttgccttggttttgtatatttatccagtcatcaaagaatgtagagtctaaatgcccaaaagataatcatgatgtttggcgaataaagaccaaagtggcagtattatgagctncaagttggagcatgtgaaagctttcaagttaaaaaaaaaggggttcctgcccttaagagtggagagataatcttggctaaaaaacctgaggaaaacagttatttttcaagtgagctgatgctgttgagctagcaatcgcaacaccttagtgcattgcacgttatatttggggatcaaaagtgggtaaccaattttgtgatggagcaggtaacat

SEQ ID NO: 7576 - DNA, 387 bp, Triticum aestivum
  Clone ID: LIB3281-053-P1-K1-F3
ctcctccatagtattctccatcggtgagacaggtggttaggagggaagagaagagggacgggagtgtggagagcagtacaaaactgaagctcacacctctctctctcccactctcttcccgcgagaaaatgatgacgaggtctccagagccggcagccgagcagaaggcctcgtcgtccttcggcaacctgctctccatcttcctccgggtcagctcgtccgagaccaagccgccgaggcggagcttcgacgccgagggcgtcgtcgggctcggcatcgtcgcggccatgagccgcgcgtgcctcaccgcccagccgatagcgatcggcgctgccgcacgccgccgcgggcgcgaggaggacgagctctcggagagctacacgtgcg

SEQ ID NO: 7577 - DNA, 350 bp, Triticum aestivum
  unsure (1)...(350): unsure at all n locations
  Clone ID: LIB3281-053-P1-K1-F4
ggaagcccagcggatctagggttgctcccgcgccgccgcgtctcgccctcctccgcggggaggatagcgggcggggctccgccggtccgagcccgggactcccgcgccgaatgcgcgggcggccggtcgagtgcggagcacatcggggtcagcctagaaggcgagaacagagctttggagatgtcttcaactgtgcccaagtcatcaaatatcttctggcatgattgcccagtgggcaagactgaccggcaaaatctactgaagcagaaagggtgtgttgtttggattacaggccttagcggttcaggtaaaagtaccttggcatgcacattangtcgagagctccatac

SEQ ID NO: 7578 - DNA, 377 bp, Triticum aestivum
  Clone ID: LIB3281-053-P1-K1-F5
cccacgcgtccgacgagctagcaagggaggtggaggaagataaagccgagattgaggccttgaaacatgacatccagaagctgcgagaggaggtggatgaggagcggaagatgctgcagatggctgaggtgtggcgcgaagaacggtgcagatgaagcttgttgacgcaaaactcaccttggatgccaaatacacagaactgagcagactgcagcaggatgttgaggcctttgttgccgcatgcagttctgctagaggagacatcatggtcgtggaacaagcagagaacattatacatgcaatcaagtcagtcagagcacaggatgttgaattcaggtatgagccaccagcagaatcagaggacatattctcaattt

SEQ ID NO: 7579 - DNA, 399 bp, Triticum aestivum
  Clone ID: LIB3281-053-P1-K1-F6
cggacgcgtgggttttttttttcaagaaaagtatccctgattccgagggacttaaaaaaatacacaatggcatctcctctgttttgttgaatacaaggtacatgtatcaagatatcccaacctaacgggttgagggaaaaatggtgatttcgagaccacctcaacttgcgggggaaatgtcagcagctcatatctatttacacagtagaaacacgagcgatggtacaactttccaaagaataatacacactacctacattctttctttcctttaagaaaaatatgaacaatgcctatctactcacccctagaagaaatagctggtcaacagcaaacaaagaggatcttacacttcgctagaggactagttggatggctgtgacaatgcgagatcacaaa

SEQ ID NO: 7580 - DNA, 117 bp, Triticum aestivum
  Clone ID: LIB3281-053-P1-K1-F8
ggtgtgtgtcagtcggttggtgcttgtcgtatttcttggatgttaccgttaaataataggaacggccttggtgccgtttctgaaataataatagtagcatccatcctcgtttccaag

SEQ ID NO: 7581 - DNA, 350 bp, Triticum aestivum
  Clone ID: LIB3281-053-P1-K1-F9
cggacgcgtgggcggacgcgtgggcggacgcgtgggcttgtcccgccgccgccccgcgaagcaaagcaggaggagaaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatg

SEQ ID NO: 7582 - DNA, 391 bp, Triticum aestivum
  Clone ID: LIB3281-053-P1-K1-G1
cggacgcgtgggtcccaatgttacagtcaaccctgatgaggttgtggctcttggggcggccgtacagggtggagttttggctggagatgtgaaggatgttgttcttcttgatgttactccattgtcaattggtttggagacgttgggtggagtgatgacgaagattatccccaggaatacaacactgcccacctgcaaatcagaggtattctcaacggctgctgatggacagacaagtgttgagattaatgtcctccagggagagagagagtttgtcagggacaacaagtctcttggaagcttccgactggatgggatccctcccgcaccacgtggtgtaccacaaattgaagtgaagtttgacattgatgccaatggcattctgtcagta

SEQ ID NO: 7583 - DNA, 287 bp, Triticum aestivum
  Clone ID: LIB3281-053-P1-K1-G10
aatatagtttctagaataatcttcaatgagaaataaacttggtagggtaaacaatgaatttatgatctttaagctttagccgacacatcagtctttacaaccttaaaatatactgatctaaaatattcatagcttgaaagagcaagtagatttccttcactaaactgctgctcaggttggtcacctcggatcacatcagtgcctacagcactttcaataacagacttgctaaaacttcttactactggcacgctttcctgcaaaggtggttcgatccaagagcctta

SEQ ID NO: 7584 - DNA, 393 bp, Triticum aestivum
  Clone ID: LIB3281-053-P1-K1-G12
cggacgcgtgggcggacgcgtgggggattcttgagcttgctgaagagctgtgcatgccgcttgctgccgtgaagtactctcgtgggatgttcatcttccccggcgcacagcctgctccccacaggagcttctctgaggaggttgatgtcctgaaccgctacttcggacacctgaagtctggcggcaatgcttatgtgatcggagacccagcgaagcctggccagaagtggcacatctactatgccaccgagcaacctgagcagcccatggtcaccctggagatgtgcatgactgggctggacaagaagaaggcctctgtcttcttcaagactcaagctgatagccacgtttcctgcgccaaggagatgaccaagctctctggtatctacgaca

SEQ ID NO: 7585 - DNA, 358 bp, Triticum aestivum
  Clone ID: LIB3281-053-P1-K1-G2
gcgcgatctgcctcgacaggatcccgctccaggagacggcgctcgtcaagggctgcgaccacgcctactgcgtcacttgcattctgaggtgggcatcctacaagcagacaccagtatgccctcaatgcaagcacccgtttgagttcctcagtgtgcatcgctctcttgatggctgccttcatgactacatgttcgatgagagcgtttgtcttcttctgagagccacttggtttaagcctctggtcgtagaggctcacgaggaggctcaagaggaagaagacatttaccgtagttaccaatatgatgatggcgatgaggatgacctttatgaggaatacataagcaggtcaccgagcat

SEQ ID NO: 7586 - DNA, 367 bp, Triticum aestivum
  Clone ID: LIB3281-053-P1-K1-G3
cccacgcgtgcgactaaatcgagaccacaggatgaaacctctagttagtggggagctatctaatacaccatgacccataacctgtaattaccgagcatctgggaggagccctgggttacgctttaggatttttactttttagggaagaacggcggtggcgattggaaacagctagtgtggaacctcttatgttttacctcttgtcgattgacagttcttctttcgtaatgttgttgtacacattgggcagtgccaaattgcacaagctgctcttactgcctacagggatctcttctgttttttttatataatatctactgcacatttccacttaaaggggctcaataagaacaagtacttaaacctt

SEQ ID NO: 7587 - DNA, 373 bp, Triticum aestivum
  unsure (1)...(373): unsure at all n locations
  Clone ID: LIB3281-053-P1-K1-G4
cggacgcgtgggcacagactcgagcgcccccccatcctcatcctgctccctaaccaagaagcgagacgacggtgaccagtccccagagcgcactcccacaccatggatctccagaccttcgtgctgagggtgaccatccactgccatggctgcaagaagaaggtccggaaggtgctcaagagcgtcgaaggcgtgcaggacgtgaaggtggatgcccagctgcacaaggtgatggtgaccggcaccgtggacgccgagacgctcatcaagcggctgcacaagtcgggcaagcaggccctgccatggcaacacacgcctgccaagaatcccgaccctgcgccgncagccccagccgacgcccccgcgccggccg

SEQ ID NO: 7588 - DNA, 158 bp, Triticum aestivum
  Clone ID: LIB3281-053-P1-K1-G5
cccacgcgttcgcccacgcgtccgcccacgcgtccgcccactcgtgcggggattacggtaataaaagggaaagttgaagaaattgagcttcctgtcccaaaagtagatgtcataatctctgaatggatggtttatttcctcctgcatgagaatatgtt

SEQ ID NO: 7589 - DNA, 166 bp, Triticum aestivum
  Clone ID: LIB3281-053-P1-K1-G6
cggacgcgtgggcggacgcgtgggcggacgcgtgggtgcttgcatgatagcactgtagatatattcttgcatggtatttattgttgatgctagtggtcatgttatgttatgagtagtgttgcacttgtaatatttatgctcgtcattatgccatgttcagttggat

SEQ ID NO: 7590 - DNA, 339 bp, Triticum aestivum
  Clone ID: LIB3281-053-P1-K1-G7
ggaaaaaactcactgcagataagagagggaggggcgagcgagagagaagggagaggcggcgcgccgagccagcccacttccgcccgcggccatggccggcgccgaccccaaccggagcttcatgaaggacgtgaagcgcatcatcatcaaggtgggcactgcagttatcaccagaaatgatggaagactggctttgggcaggattggagccctgtgcgagcaggtcaaggatcttaatgctcaaggatatgaggtgattatggtcacctcgggcgctgttggtgtggggcgacagcggctcaagtaccgcaagctcgtcaatagcagctttgctgatct

SEQ ID NO: 7591 - DNA, 350 bp, Triticum aestivum
  Clone ID: LIB3281-053-P1-K1-G8
gaagctccagctcgcggcgagggttatcgtcgccatcgagaaccggcaggacatcatcgtccagtccgcccgcccctacggccaacgcgccgtcctcaagttcgcgcagcacacaggcgccaacgccatcgccgggaggcacacccctggaaccttcaccaaccagatgcagacctccttcagcgagccccgtctgctcatcctcaccgacccaaggactgaccaccagcccatcaaggagtctgctctggggaacatccctaccattgccttctgtgacactggactctccatgcgatacgtcgatatcggcatcccagcaaacaacaaggggagggacagcattggct

SEQ ID NO: 7592 - DNA, 360 bp, Triticum aestivum
  Clone ID: LIB3281-053-P1-K1-G9
cggacgcgtgggccccaccggcaccgaacaatggcggcgtgcaacggcctgtttgtgtaccacatcctcggcctggcctccctggtggccgtgttctacttctccctcctcggtgaggtggacctccgcttccccggcctcctcccgtcccccggcgcgtcccagtcccacgacgcgtccctgccgttcgtggagcggcgcggcgcgcagctcttcctggggggccggccattctacatcaacgggtggaactcgtactggctcatggaccaggcggtggagccggccagccgccaccgcgtgtcggacatgttccgcgccgccaccgggatggggctcacggtgtgccgcacctgggcc

SEQ ID NO: 7593 - DNA, 391 bp, Triticum aestivum
  Clone ID: LIB3281-053-P1-K1-H1
gaaagattcagccacacagccaaaagtgaagtatttcactcaggtgaaagcgcggccaccaacatttgtcacctttatgagtgggaagactgagctatctgatacagatatcaggttcttgacaagatctctcaaggaagatttcgacatcgggggaataccaatccggatcctacagcgttctattccaagaaaagtgtcgtctttcaagagcaatatcaagaaaagaggatctagtataaaaaggatgaaaacagacaaaagaacagaagtgtctgatcctacccagtcatgattttacaatgtcaccaaagcacctcccgattctcacagaggacctggtatgtgtgtaccactcacaagggaagtcattagtcatgacctacatact

SEQ ID NO: 7594 - DNA, 363 bp, Triticum aestivum
  Clone ID: LIB3281-053-P1-K1-H10
gcggggcctgcatggacatggcggacctcgacggcgacggctccgccccgccgcacaccacggtgccggcggccgatctgcgggagctcgtgaagagacgggaggtcggccacccgatcaccatctacgactcgccggcgagcaccgtcacggtcgtcagctcgtcgtccggggagcttagacaggggaggctccagggcagcgcgagatcggacagcgcgcactggcctcgggtgagcatctacaagggccatccgttcgtgagaaaccacagctccgaagccggcaagctcatcaatcttcccgccacgatggaggggttcaaaaccatcatcggagagaagcttaaagtggacgcggaga

SEQ ID NO: 7595 - DNA, 294 bp, Triticum aestivum
  Clone ID: LIB3281-053-P1-K1-H12
cccacgcgtccgcggacgcgtggggtcagcttgagttcaaggccgtcctcttcgttcccaagagggccccctttgacctctttgacaccaggaagaagctcaacaacattaagctctatgtgcgccgtgtcttcatcatggacaactgtgaggagctgatcccagagtggctgagctttgtcaagggcattgttgactctgaggatcttcccctcaacatctctcgtgagacactccagcagaacaagatcctcaaggtcatcaagaagaaccctgtgaaagagtgcatcgagc

SEQ ID NO: 7596 - DNA, 395 bp, Triticum aestivum
  Clone ID: LIB3281-053-P1-K1-H2
caactttccccgtctgtctttcttctcggcggaggcgaacgacgaaccctagccgcgcgaggaacgccaagatccccaaggccggcgacgatggcggcggttcggtgcgcggcgaggaggctcggcggctctctgctccagcgaacgcaggcggcggtcgcggaggagggacgcctgctcgcgccaagcaggctcatgcgctcccgccagctctccaccaaggtctccggcgagcgatcgcaagtggcggagcgacacctcctcgagccaggcagtctcatgcgctcccgccagctctacggcgagcatgctcgcaacattccagaaaaaagagggtgactgctgggcggtgttcaatgagacgctaaagaggttggacgagcttcaaaaaaaga

SEQ ID NO: 7597 - DNA, 254 bp, Triticum aestivum
  Clone ID: LIB3281-053-P1-K1-H3
ggaacgcgctcgacttgatcagttcccaggggcatgcgacgtacgtcatggtcccaccgatagacacgcacaaccccacggtcactgaatatgcgtgtagtgagctcacacccgattaggttagttgagtgtatactgcggaggacataagcatctggcatctcaaaaacccctgtgatccaaacatgttcgctccatggataaatgctagctctaatgcttgaagtcgaatatctagcttaagcggtgatccc

SEQ ID NO: 7598 - DNA, 380 bp, Triticum aestivum
  Clone ID: LIB3281-053-P1-K1-H6
cggacgcgtgggcgagcggaaacggagcgagggcctttgtgtccatcccgacctctcgtggccgcacgagaagaaaaggagcttatcatggcttcaaaacgtatcctgaaggaactcaaggacttgcagaaagatcctccgacatcatgcagtgcaggtccttctggcgaggatatgttccattggcaggcaaccattatgggtcctcctgatagtccctatgctggaggtgttttcttagtgaatatccatttccccccggactaccccttcaagcctccgaaggtatcgttcaagacaaaggtcttccatccgaacatcaatagcaatggaagcatatgcctcgacattctgaaggagcaatggagtcctgctttgac

SEQ ID NO: 7599 - DNA, 354 bp, Triticum aestivum
  Clone ID: LIB3281-053-P1-K1-H7
atcggatcggggaaaaggcctccacgagctctcgtctcgactgccgccgccgcccgagatggcgatccgccgtgggccctcctgcgccgccctcgccctgctcgcgctcgcctccgtcgccgcggtctccgccgacgtcttcttccaggagaagttcgaagatggttgggaaagccggtgggtcaagtctgagtggaagaaggatgagaacatggctggtgaatggaaccacacatctggaaaatggcatggagatgctgaggacaaaggtatccaaacctcagaggactacaggttctacgccatctcggcggagtaccctgagttcagcaacaaggacaagacacttgggct

SEQ ID NO: 7600 - DNA, 387 bp, Triticum aestivum
  Clone ID: LIB3281-053-P1-K1-H8
cgccctttttctttttttttaactcaatcatccattcattcattcattcatttgcttgcttgcatagacaatagagttgtaagtcgatttctctctccaatatgtcatgtcaatgggatggctacattacaaagtccataggattacggtagagacagcctaaagttacttaacacacacagacagacaccaagtgaagtatatacaccacaccagcaacaccaacaggagtatatagagagaggagcctacgaacgaagaacgatgaggaagagtacaggagcagagcatatttgtatcgtttagtttataccggctggtagctcagggacctccagacaccaaccaagacaagcacaagcagagggggatgggcatcaccaggag

SEQ ID NO: 7601 - DNA, 251 bp, Triticum aestivum
  Clone ID: LIB3281-053-P1-K1-H9
gtctcaagcagcgatgagaagggagctaagtcagcaacatctgccactttttactgctctgggtataactggcagctgcaagtgattccaatgcataaagaaactggttctgaaacaccatatgttgctcttcgtcttatgacatccccagaaaggatggtgccaggtcacacgatgcatgtggtttttgagttgtcaatatacaaccattcaaaaggaatgtactgtggatgcaaagctagctacaactt

SEQ ID NO: 7602 - DNA, 358 bp, Triticum aestivum
  unsure (1)...(358): unsure at all n locations
  Clone ID: LIB3281-054-P1-K1-A1
cccacgcgtccggataaagggagacataatgactgatgatcaaaaggcaaatacagataatgttaaccagcaggaagttatagaacagaaagatccgaaaattgatgaaacaaacgaaaagagtgaccagaaaaaggatgacaacgaaacaaaggataaagaccaaaagatggactcaaagaaaaagtcgcccattgacaccaaaaaaaagaagaagtctgatgagcctccgaaacacccaggattcattctccaagccaaaaagagcaaaggatataaactccgttcaacatccctttcattggatggcctnctggactacaccgccaatgatacagaggagtctgtatttgagctt

SEQ ID NO: 7603 - DNA, 352 bp, Triticum aestivum
  Clone ID: LIB3281-054-P1-K1-A11
ggcggaatttgggctcgagtgcattggagatagaccggagctgactccggacacggtacgagaactggagcagctgcatctgatcagggggcggcaagtaccgtccttcttcctgtgcccaattctcaagcaaaccatggatgatcctcaggtggccgcggacggggtgacgtacgaggggcgcgctattcgtgagtggatcgaggatggccgggccgtggccgacctgaagctgaagcaccttgacctcacccccaaccacgccctccggttcgccattcaagactggctctctcagccttaatggtgaatgatgatgatgatgatgatgattctccagctgctgttttca

SEQ ID NO: 7604 - DNA, 405 bp, Triticum aestivum
  Clone ID: LIB3281-054-P1-K1-A3
gcccgcaggcaccggcacgtaccggcccggtcgacccacgccgacgcagacgcgtgggaacgccttgaaagatgccaagctatctgttagtaatctagatgaagtgattcttgtgggtggatccacccgaatccctgcagtgcaagaaactgttaggaagattacaggcaaggatcccaatgttacagtcaaccctgatgaggttgtttctcttggggcggccgtacagggtggagttttggctggagatgtgaaagatgttgttcttcttgatgttactccattgtcaattggtttggagacgttgggtggagtgatgacgaatattatccccaggaatacaacactgcccacctccaaatcagaggtattctcaacggctgctgatggacagacaagtgttga

SEQ ID NO: 7605 - DNA, 329 bp, Triticum aestivum
  Clone ID: LIB3281-054-P1-K1-A4
cccacgcgtccgccacaatctcacctactccggccatctctccggcgaccaccgcagcaccacccttccttccgactccagcgatggcgacagcggcagccggcggcgggaggggcaagccgaagggcagcaagtcggtgtcgcggtcggtgaaggcgggcctgcagttccccgtcggccgcgtcgcccggcacctcaaggtcggccgctacgcgaagcgcgtgggcgcgggcgcccccgtctacctctgcgccgtcctcgagtacctcgccgccgaggccctggagctgggcggcaacgcggcgcgcgacaacaagaaaacccggatc

SEQ ID NO: 7606 - DNA, 317 bp, Triticum aestivum
  Clone ID: LIB3281-054-P1-K1-A5
cccacgcgtccgccacaatttcacctactccggccatctcttcggcgaccaccggagcaccaccctttcttccgactccagcgatggcgacagcggcagccggcggcgggaggggcaagccgaagggcagcatgtcggtgtcgcggtcggtgaaggcgggcctgcagttccccgtcggccgcgtcgaccggcacctcaaggtcggccgctacacgaagcgcgtgggcgcgggcgcccccgtctacctctgcgccgtccttgagtacctcgccgcctaggccctggagctggtctgtaacgcggcgcgcgacaacaag

SEQ ID NO: 7607 - DNA, 149 bp, Triticum aestivum
  Clone ID: LIB3281-054-P1-K1-A6
ctcataatttatgctcgagtgccgctctagaatatccaggcgtagcggctcacacgggacgagaacttcatcatctgcatctgatcaggaaattcaatttactggaccttatttcattacccaaattattaagcaaaaccattgtatta

SEQ ID NO: 7608 - DNA, 348 bp, Triticum aestivum
  Clone ID: LIB3281-054-P1-K1-A7
tcgctacgccgccgcagccgctcctgtacccgccgccgagatgacgaagcgcaccagaggccggaatctcgggaagtatggtaccaggtatggtgccagtttgcgtaagcagatcaagaagatggggtgtctagcactccaagtacttctggaattctgtgggaagttgctgtaagaggaaagctgtggaatttgggatgcaaggactgtggcaaggtaaggctggcggcgcctataccatgaacactgtgtgcagcaccgtaggagcacgatccgtccttgaggagcagaccgaacatgattgccctactgttcttgaggaatcaggttctgtagggagtgaagact

SEQ ID NO: 7609 - DNA, 376 bp, Triticum aestivum
  Clone ID: LIB3281-054-P1-K1-A8
cccacgcgtccgcccacgcgtccgcactcctctccctgcccaagaaaaaccgccgccgccgccgccgcagcaacagcaggcgagcgagatggtgtttgtgaagaaccagaagaccagggcgtactccaagcggttccaagtgaagttcaagagaaggagacaggggaagaccgattacagggccaggctcaggctcactaaccaagacaagaacaagtacaacacgcccaagtaccggtttgttgtgcgatttaccaacaaagatgtcactgcccaaattgtgtacgccaccatcgctggtgatatcgtgatggctgctgcctattcccatgagcttcctcggtatggtcttgaagttggccttaccaactatgcc

SEQ ID NO: 7610 - DNA, 373 bp, Triticum aestivum
  Clone ID: LIB3281-054-P1-K1-A9
gcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggc

SEQ ID NO: 7611 - DNA, 324 bp, Triticum aestivum
  Clone ID: LIB3281-054-P1-K1-B10
cccacgcgtccgcggacgcgtgggcccagtggtgtgtgcagggaaggtttcctggattaattgtagatctgattccttccctgcccagtggtgtgtgcaacaggcgagcaagtaggagtgtctggttccaagagaaagcgtcggaagcattacgtttaccttgtttttgatgactggtcgtacggatatagcatccacaaggtaaacttggttccctgctctcgccgacgtaagcagactgcattctcagcaccagccgatgtgccgtgcctgcctacggcactcttccggttggaagcaacgcatgggtcgccagagtacatc

SEQ ID NO: 7612 - DNA, 380 bp, Triticum aestivum
  Clone ID: LIB3281-054-P1-K1-B11
cccacgcgtccgcggacgcgtggggctcccgcccctccgcttcccgcctccgctgccgcttcctctccgcccttgcagcgggcgggacgcctccgccgccgcggtccggcctagtgtacgggttcggtgacaacagccacggggccgtgggccagcctgcgccggccgcggacgtctacgtccccacgcccgtgccctccctcccgtcgtccgtcgatgcggtcgcagccggacactaccactccctcgctgtatcctctgccggggaggtctgggcgtgggggcgcaacgaagagggccagctcggccgcgggctccaggccccgaggaatacttggagcaatccagaacaggtgagaggattggagaatgttcaagtt

SEQ ID NO: 7613 - DNA, 162 bp, Triticum aestivum
  Clone ID: LIB3281-054-P1-K1-B12
ctggctacacatatatttggccgtgtgtgtataatcttgggtgggagacatttgacgaacgaggcaggaaaggctgctccagtccagtgtttatttctatctagttgtttgattgaaggtctgtttcccggatataatttttggcacggtcagctccattcc

SEQ ID NO: 7614 - DNA, 412 bp, Triticum aestivum
  unsure (1)...(412): unsure at all n locations
  Clone ID: LIB3281-054-P1-K1-B2
cggaanggccgggnngggcggttttttttttttttttttttttggcaatctaataacttgcatttcacaacaaatcagtctcagggcacaggagtttagccgaagcaggaatagaaatacagtaattaaacgacagacaggatcattgctcgcccgggataagagtctgcagcaacaaaagcaatgaccatgaacaaaaaccttctgctaaatagatgcctatttcttcttgatggcagccttggtaaccttggcgccggtggggtccttcttctccacgcccttgatgacaccaacagcaaccgtttgtcttatgtcacgcacagcgaagcggccaagaggagggtaggtggcgaaggtctccacaaccatgggcttggtgggaatcatcttcacgataccagcgtcaccg

SEQ ID NO: 7615 - DNA, 385 bp, Triticum aestivum
  Clone ID: LIB3281-054-P1-K1-B3
cggacgcgtgggcaacacaaggcaatcccacgcagagacagaaagaagcagcggcggcggcgaagatgtccgggagaggcaagggaggaaaggggctgggcaagggcggcgccaagcgccaccgcaaggtgctccgcgacaacatccaggggatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccaccaa

SEQ ID NO: 7616 - DNA, 98 bp, Triticum aestivum
  Clone ID: LIB3281-054-P1-K1-B4
cccacgcgtccggcttatagtaaaataaactgagtttttctcaagcattagtgcttgtctctgtagaaggggtgtctaattaagcatctactctttac

SEQ ID NO: 7617 - DNA, 380 bp, Triticum aestivum
  Clone ID: LIB3281-054-P1-K1-B6
cctagtactcaagcacctccttctggagcagcttccaaaacacctcaaaagaagccatctgctgggcagaagaaacctttggaagcaattggctcatctcctccaccatctggcaaaaagcagaagggatctggaggcttccatgatcaaagcattgaccagctgaatgatgttactgcagttagtggtgttaatctgagggaagaggaggagcaacttttctctgctcctaaggaagagagtcgagtttcagaagctgctcgtaaagttgtacaactagaagaagaaaggctcattctacagaaggggcctctgacaaagaaattagcagagatcatgagaaaatataatctgaagagcataggatgtgacgtagagcg

SEQ ID NO: 7618 - DNA, 376 bp, Triticum aestivum
  Clone ID: LIB3281-054-P1-K1-B7
cccacgcgtccgaatatcagtttccgtatatatcgtgtcgccagggccaacacggcggcctagcttaccttgtagttcatccagagaacacacaatggccgtagcgatgccagctgcgcgctcgcttctcctgcttctcctcctggttgcgccgctggcgccgggctcgtcggaggcggcagtccggccgaaccccaagatcgtcaactgggtcgcagacaatgcccgcgcctccacgcccgacagcttcggcgccctcgtcttcgacctctccgtcggcacgccgcggcagaccctctccttcgtcatggacatcaccgagcagctcgtctgggcgcagtgcggccaacatgggttcacgcagtcgcaggcgccc

SEQ ID NO: 7619 - DNA, 374 bp, Triticum aestivum
  Clone ID: LIB3281-054-P1-K1-B8
cgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacga

SEQ ID NO: 7620 - DNA, 360 bp, Triticum aestivum
  Clone ID: LIB3281-054-P1-K1-B9
ggctacaatttccatgcctacagctgaaggagcgactgtagctgcagagaggcttcagagcatggtaacattgtttatgagaaaaatccacgacggactaataacctacttcttctaggaagtatctactgtaagtttatgacttggtgctagctgaagcttgcattttctaccaaaactgctattaacaaaagaactctagcgacccaggattttatctttaactgctattaaactcacaagagggagcattttaataacaaaagaactctatccatgttttctgatatactgtgtatatgcatgatgtactagcagttcctattttttaactattgcgtaccagaaaaacgaattggt

SEQ ID NO: 7621 - DNA, 388 bp, Triticum aestivum
  unsure (1)...(388): unsure at all n locations
  Clone ID: LIB3281-054-P1-K1-C1
cgcggaccgcgtngggcggacgcgtggggngaaacgttcagntctcgtctctatcatcgtcatctaaaagtccacttacgacttcgatgattcaagatgatgtggatgatagtaataatgattttattgagcaatttgctatggtgtctggaagccattcttctacattggataggctacatgcatgggagagaaaattatatgatgaaatcaaggcaagtgaaaatgtcagaaagacttatgacgagaaatgtaaccttctccggcaccaatttacacgaggtctaaatgcagaactcattgataagactcgagctgttgtgaaggatctgcactccagggtttctgttgcaatccaggctgttgatgcaatctcaaaaagaattga

SEQ ID NO: 7622 - DNA, 344 bp, Triticum aestivum
  unsure (1)...(344): unsure at all n locations
  Clone ID: LIB3281-054-P1-K1-C10
acgacacattcttaaatgcaggcaaggaggggtggcttcttctcctcctcctcctcctcctgcaacggtacaagagccagcgccagcaccatcacttccccactcctccactagccactgcccctcccttccacatacacacacacacacaccatctntttctccatccatcctcccctcctccccaaagagagcttgcacagcaacttggaaacggcggtgatctgcaaagatgaccaaagatgaggacttcaagctggtcaagatccagacccacgtcctgagggtgaacatacactgcgacggctgcaagcacaaggtcaagaagctgctccagaggatcg

SEQ ID NO: 7623 - DNA, 337 bp, Triticum aestivum
  Clone ID: LIB3281-054-P1-K1-C11
gttaatccataaccagcacatgcaactcaaatacccacaattcaaacccaaaatgttccaaactcaatactcatggactacatttcaagttcttgacaaaagcaagacaacaccatccaaaagccatgcgagcagatattttacataacaataaatactcagacgcgtgaacacccagcgggggtgaagatggactctgctcaagacaccttctgactgtcacaaaaagttctcagcatatttcatcgtcaacgactaccaacttccgtcgacaggaaggaccgacaaactgactcatgccaccgagcaatgctcagcagtaccattgtgacgggtg

SEQ ID NO: 7624 - DNA, 331 bp, Triticum aestivum
  Clone ID: LIB3281-054-P1-K1-C12
cggacgcatgggttcgccttcctagaactgcacaacaaagggtcccttgtgcaacatcaacggcctgctcgtttgaaaccacgctgtatgtggcctgacgatttcgtctagaatttcgactcaagatcgactttgttcagtccccatgctgaatgctgaatgtggcttgacgatttcatctagaattctaactcgagctcgactttattcagctgggtacatagcttcgaaaatggtcttactgaaagacaactacaccaacatacactctgcgccagcactctctcgtggcaaccagggctggggaggtttttctttcgaaaatctcagc

SEQ ID NO: 7625 - DNA, 381 bp, Triticum aestivum
  Clone ID: LIB3281-054-P1-K1-C2
ttttcctctccctcctcctgaccacccacccacctaccagccaccaaggcgggcgatctcccctccccagccgcgccaccgtcgacgccgcagctccggcagccgttcgtctcgagattgatctttggtgactgttagaagccacagacactgaagatggcgcagcctgctgagctttcccgcgaggagaatgtgtacatggccaagcttgcagagcaagctgagaggtacgaggagatggttgagttcatggagaaggtggccaagacagttgactccgaggagctcacagtcgaggagcgcaaccttctatcagttgcttacaagaatgttattggtgcccgccgcgcctcgtggcgcattattttcttcattgagcag

SEQ ID NO: 7626 - DNA, 339 bp, Triticum aestivum
  Clone ID: LIB3281-054-P1-K1-C3
ctcacgcgtgcgtggtctcgtccaccaaaccaccaaccacatatcggggctccgggtctaaactaccaattcaaaccaccatcctccccgaatttctggcagacggtcgtctggagattgatctatcgtgactgttagaagccacagacactgtatatgacgcagactgctgagctttcctgcgaggagaatgtttacatcagcaaactcgcatagcaagattagaggtactaggatatcgtggagttcatcgttaaggtgaacaagacagctgacttcgtgaagcccacactcaaagagcacacccttgtattagttgcttacaagaattttaatggt

SEQ ID NO: 7627 - DNA, 374 bp, Triticum aestivum
  Clone ID: LIB3281-054-P1-K1-C4
aagatcttctccaccttcgtcacgttcttgaagagcaaggatgccagcgatggttcggagaaggcacttgttgacgagctgcaggcactcgaagagcacctgaaggcccatggaccctacatcaacggggcgaacatctccgccgtcgatctcagcctggctccgaagctctaccacctccaggtcgccctggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagccctcccgctgcttggagacccgacccaccccca

SEQ ID NO: 7628 - DNA, 324 bp, Triticum aestivum
  unsure (1)...(324): unsure at all n locations
  Clone ID: LIB3281-054-P1-K1-C5
ggaaaagctcacttcatcgcctccgcctccgactggccgcacccccgcacccggcgacgacgccatgattcccaacctctccgccctcgagaaccacttcggcgccgccgacgacggcagcgacgacttcgccggcctcttctccgccgacgccgccgaccagctcggccttgagttccccacctgcaacgacttcgatgggttccagaaggcgaccaatgagatggtgaacaacaagaaggggaccaccacgctctccttcatcttcgacaagggcgtnatcgtcgacgccgactaccgggccagcatgggcggctacatatc

SEQ ID NO: 7629 - DNA, 374 bp, Triticum aestivum
  unsure (1)...(374): unsure at all n locations
  Clone ID: LIB3281-054-P1-K1-C6
cggacgcgtgggcccacccttacgccgccgccgccgccgncatgggtatcgacctcgtcgccggcggccgtaacaagaggaccaagcgcaccgcgccaaagtcggacgatgtctacctcaagcttctggtgaagctctaccgcttcctggtgaggaggaccaagagccagttcaatgctgtgatcctgaagcgcctcttcatgagcaagaccaaccgcccgccgctctcgcttcgtcgcctcgtcaagttcatggacggcaaggtctcttgttcgtttgctttggtgtttattgatgcgtgattaggttcgtttcgttacttctgcatgacgctgttcggctttgcgattctggaagtgcaggacaaccaaatc

SEQ ID NO: 7630 - DNA, 319 bp, Triticum aestivum
  Clone ID: LIB3281-054-P1-K1-C7
cggacgcgtgggtgggctcttctagaactgcgcaaggggggttgtgtagtgcaacatcaacggcctgctcttttgaaaccacgctgcatgtggtctgacgattcaagagtacaatttctgctccagatctgactttgttcagcctctatgctgagtgctgaatgtggcttgaccacagcatctagtgttctaactcgagctcggctctatgcagctgcgtacatatgtttgaaaatggtcttactgaaagacaacgtctccaacgttcaccgttgcggctggccctttttgcttggcaaacaagtaatggggaggtttt

SEQ ID NO: 7631 - DNA, 372 bp, Triticum aestivum
  Clone ID: LIB3281-054-P1-K1-C8
cggacgcgtgggtgggatcaccaaggacgacgtcaaggtgttcgcggcggtgcccgtgaagcccagcgccgagttcccgaacgctgcccgctggtatgacaccgtcgccgcggctgttgctccaaggttccctggccagtcctctggggtgagtgcatcatcggctcctgctgcagctgctcctgccgcttccaaggatgaagacgaggatgatgacatggatctgtttggcgatgagaccgaggaggacaagaaagctgcagctgagcgtgaggctgccaagcctgcaaagaagaaagaaagtggcaaatcctctgtcctcatggacatcaagccatgggacgatgagactgacatgaagaagttggagga

SEQ ID NO: 7632 - DNA, 149 bp, Triticum aestivum
  Clone ID: LIB3281-054-P1-K1-C9
cggacgcgtggaacagaaatactaatagagcgttgccctgtaatcctagtcctgttttcccttcacgtatggttttcatccgttccctgtcgatatttactgtatctacatgctcatctcgtgtgattaaatggaagagacgtgtgcat

SEQ ID NO: 7633 - DNA, 257 bp, Triticum aestivum
  Clone ID: LIB3281-054-P1-K1-D1
acgcggacgcgtggggcgagaccggaaggagtgctgatacagcgccggggggagcggcgagccctatattcctcgcctcctctttctatgggtcagagatggcggtccgtactaaccacccatctgatatgcagaacgatggtggtcagtacctccttggattcagattatctgaggtgttttgtgcttaaagcagttgtttttctgggccaagctatgagaggcgctgaagcataagctgttccatgactcaaaac

SEQ ID NO: 7634 - DNA, 376 bp, Triticum aestivum
  Clone ID: LIB3281-054-P1-K1-D10
cggacgcgtgggcatgttcctgatttagaatggaggattaatgacttctcatcgctgcttgagacaggagctaagtcagcaaaatctgacgcttttcactgctctgggtacctgcacgtgagtccaatgcataaggaaattggttctgaaacgcaatatgttgctcttcgtcttaagacatccgaagcaagcatggtgccaggtcacacggtgcatgtggtttttgagttgtcaatatacaaccatacaaaaggaatgtactgcggatgcaaagatacctacaactttcatttcaagaatacctactcgaaggagcaatgcttgattcctcttcaggagctactgaaatcatctgcttttctagttgatcatagct

SEQ ID NO: 7635 - DNA, 374 bp, Triticum aestivum
  Clone ID: LIB3281-054-P1-K1-D11
cggacgcgtgggcatgttcctgatttagaatggaggaggaatgacgtgtcatcgctgcttgagacaggagctaagtcagcaaaatctgacgcttttcactgctctgggtacctgcacgtgagtccaatgcataaggaaattggttctgaaacgcaatatgttgctcttcgtcttaagacattcgaagcaagcatggtgccaggtcacacggtgcatgtggtttttgagttgtcaatatacaaccatacaaaaggaatgtactgcggatgcaaagatacctacaactttcatttcaagaatacctactcgaaggagcaatgcttgattcctcttcaggagctactgaaatcatcttgctttctagttgatcatag

SEQ ID NO: 7636 - DNA, 380 bp, Triticum aestivum
  Clone ID: LIB3281-054-P1-K1-D12
cccacgcgtccgcgaaggagataacctggacacgaggggaagaggtatcggtaaagcttcgccacaactcacattttgacaagcataacaagctttttactagttttgatactttgagttgcgtcgaatccataacgaaatcgcttctcaaagtcaataggttgctcttagtgttaacacattcgcagctaccatggttccaggtcatacggtgcatgtggtttttgagttgtcaatatacaaccatacaaattgaatgtactgtgtatgctaagataccttcaacttttattttatgaatacctacttttaggttcattgcttgttttttttttatgatctactgaaattatttgtttttttagtttaacatacctttt

SEQ ID NO: 7637 - DNA, 384 bp, Triticum aestivum
  Clone ID: LIB3281-054-P1-K1-D2
cccacgcgtccgctcgagccggttacgatttcctctcttcgccttgctcccctgccggcccctccaaaccctaggcgccgccggccaggaagtccatttaccagccatgtttggacgcatgccaaggaagaccagcaacaacaccaagtactatgaggtgcttggtgtatccaagacagcaaccccggatgagttgaagaaagcttaccggaaagctgctataaaaaaccatcctgataagggcggagaccctgagaagtttaaagaattggcacaagcttatgatgttctcaatgaccctgaaaagagggagatttatgaccaatatggagaagatgcaatcaaagaagggatgggaggcaacggcggcgctgatatgcatag

SEQ ID NO: 7638 - DNA, 292 bp, Triticum aestivum
  unsure (1)...(292): unsure at all n locations
  Clone ID: LIB3281-054-P1-K1-D3
cccacgcgtncgctgacgcctgttacgattcgctctcttcatcttgggcccctggcggacactcaaaaccctatgctccccctttcattaacttcatttaccatccatgtttcaacacatgccatagaaaaccagcaacaacaccaagtactattacgtgcttggtgtatccaatacaacaacccctgtttagtttaataaagcttaccctaaagctcctataaaaaaccattctgtttacggcggcaaccctgaaatgttttaataattgtcacaagcttattattatttt

SEQ ID NO: 7639 - DNA, 97 bp, Triticum aestivum
  unsure (1)...(97): unsure at all n locations
  Clone ID: LIB3281-054-P1-K1-D4
cccacgcgtncgcggactcgtgttctgaagcgtaggcttaatcatggggtgggggggctcatttaaggaagttttttcatccattccaggagggact

SEQ ID NO: 7640 - DNA, 377 bp, Triticum aestivum
  Clone ID: LIB3281-054-P1-K1-D5
gcgcaggtgacgaggaggaagccggcgacgaggccgatgccgaagttgcggggctcgacggtgcgggtgaaggcattcaagaacttcctaagaaacaaaaggacgacatttgtacaatcatgtacaccagtggaacaacaggagagccaaagggtgtgataatcacgaacagggctatcgtagctggggttacgaccacagagcacctcctccaattgacagataaagtggtggacgaatatgattcatacttttcctatcttccattagctcacattttcgatcaagtaatcgggaattactgcatctccaaaggggcttccattggattctggcaaggggacattaagtacctgatggaggatgtgcaagtgatg

SEQ ID NO: 7641 - DNA, 376 bp, Triticum aestivum
  Clone ID: LIB3281-054-P1-K1-D6
gcattctctgccggcggaccaagaactgcgccgcgctcgtcggggaggcaggggtcggcaagacggccatcattgagggcctcacccagcgcattgccagcgggaaagtccctgcgagccttgccggagcgcgtgtggtagaggtcgacctcggagccatgctggccgggactagtctccgtggcatgtttgaggagcgcatcaaggacgtgataaagagcgcagaggacggggatggcaaggtgatcctcttcatcgacgagatgcacatgcttcttggtgccggcgacgatgtaagtggcacggacgccgccaacctgctgaagccggcgctggcccgtggactcattcgctgtgtcggcgccaccaccctcaa

SEQ ID NO: 7642 - DNA, 313 bp, Triticum aestivum
  Clone ID: LIB3281-054-P1-K1-D7
cgcacgcgtcggcgaaggagatatcttggacacgaggggaatttgggggcgtagatgtacatatcatttattatattagcaaactacttgtgccttccacgtgctgtaggtacgccaagggtgagtccattgtatctccgaaagttgttatgcaactcgttattgaaattcttgaactacgacattgggagtaagcgcgattccaggtgctgcgacgaatttgtattgtggggttgtgttatacaaccagactataggtatgtcttgatgaagcatgggttcctacaggtcttattctaaaagtacctatttg

SEQ ID NO: 7643 - DNA, 285 bp, Triticum aestivum
  Clone ID: LIB3281-054-P1-K1-D9
cgccttcctcgccgtcctcgccttcaccatctccgtctacatcatgtcccgcccaggcccatctacctcatcgacttcgccacttacaagcccgccgacgaactcaaggtctccaaggcggagttcatcgacctggcgcgcaagtcgggcaagttcgacgaggagagcctggcgttccaggcgcggcttctggccaagtccggcatcggggacgagtcctacatgccgcgctgcgtcttccagcccgacgccaactgcgccaccatgaaagagggccgcgccgag

SEQ ID NO: 7644 - DNA, 380 bp, Triticum aestivum
  Clone ID: LIB3281-054-P1-K1-E1
cccacgcgtccgcggacgcgtgggcaccgaaacatatgatgtgacgacaatcagggcaagcacgccaatgttcctgatgtcacgcaagatcaagtcacttggggtcaagatggtcatctctggtgagggttccgatgagattttcggagggtacctctacttccacaaggcacccaacaaagaggagctccaccgtgagacatgtcaaaagatcaaagctctgcatcagtacgattgcttgagggccaacaaggcaacatctgcatggggcctcgaagcacgtgtgccattcttggacaaggagtttatcaatgaggcaatgagcattgatcctgagtggaagatgatccggcctgatcttggaagaattgagaaatgga

SEQ ID NO: 7645 - DNA, 378 bp, Triticum aestivum
  Clone ID: LIB3281-054-P1-K1-E10
cggacgcgtgggctcttcttctccctcggcggcgcctcgtctctgcccgcctccatccggctaccctccgcctcgcccgccgccgaccttgcctcctcccgcatgcgcgaggccgagctccacgccctctacctcctccgctcccagcgctccggcctcctcagcctcttcaaccgcactgctgcccctgagcccaccaacagctctaccgccgcccctgtctcgctgtctgatctccaggctgcgctcctcagccagatcaagatcaaccgcgagatccaggagtcgctcctctcaacgcaccactccgggaccggcaatgctacggaggatgctttggatcttgatctgccaggtcccgtgtgcaggaggagggaa

SEQ ID NO: 7646 - DNA, 382 bp, Triticum aestivum
  Clone ID: LIB3281-054-P1-K1-E11
cccacgcgtccgcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgcccagtaccctcccctgggccgctttgctgtgcgtgacatgaggcagacggttgccgtgggcgttatcaaggctgtggagaagaaggatccgaccggc

SEQ ID NO: 7647 - DNA, 278 bp, Triticum aestivum
  Clone ID: LIB3281-054-P1-K1-E2
cggacgcgtgggccaaaccccagctccatggcgacggtggcgatggacatctcgaagcccccgccggccgcgtccggcgacgagtcggccaagggcgcgcgtggcggaggcgaggggctgcgccagtactacctgcagcacattcacgacctgcagcttcagatccgccagaagacgcacaacctcaatcgcctcgaggcccagcgcaacgacctcaactcccgagttagaatgcttagggaagagctacagttactccaagagcctggctcttatgt

SEQ ID NO: 7648 - DNA, 384 bp, Triticum aestivum
  Clone ID: LIB3281-054-P1-K1-E3
cccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtaggttaggatttttatgc

SEQ ID NO: 7649 - DNA, 384 bp, Triticum aestivum
  Clone ID: LIB3281-054-P1-K1-E4
cggacgcctgggttacaagccatgcaattatgagctttttgtgaagcagtcactgaacatggaaatggctattgttatgtcaagggaggctggaatggattggatcatacatattgataccgacgagttaattcatccaccgggtgccagggagcactctcttaggcggctgcttctggatatacgctataactttcacatgcttatcttgcccaactataagagcagcgttgaactggatcacattcaacatccttttactggggttgacatgtttaataagaactacgatcatatttcggaggatacatactttggcctatacaaagaggccacgctgggtcatccaaactacttcctcacttatagagatgggaaatcagc

SEQ ID NO: 7650 - DNA, 388 bp, Triticum aestivum
  Clone ID: LIB3281-054-P1-K1-E5
cggacgcgtgggattagtcacagaatatttagctggcaagatacaaattttatgattcatccatctctccaattctgaccttacatatcaacctgtctccatgtacccttctatatctggtgctgctacttttttttccttacatggatatatgtatgagatttctttgtttaggtatatttgtgcctgaaagaagtttacatctattttcttgttagatgatcctgaatgagaatacttatgagatcgcatgaatgagatgttgacgccctgtatgctccaaaattgtatcattcttcccacacaatggttagaatcccaggtgttgaatcacaatagacaagaccatatttcccattttctatagtccaactaaaaatacatattg

SEQ ID NO: 7651 - DNA, 349 bp, Triticum aestivum
  Clone ID: LIB3281-054-P1-K1-E7
gctaattgatccaacaatccagaatgcagttgcaggggctggaccttgctggttcaatgctatataaagtgtcggcgctaaattgaaagggggggcggctctattaaggtgttggctcgctatgtacaccaactgaaatatagcctagacactgcataccaattgatgtttgcgccacatctatgtgggactcaaacaaatgagctgcatcttatactaccttaccaggggcagcattatcctaataggcactgacttgaacgccaaaccgaactgctggcccatcgagacacatttattctaatgcccgacgcatgttatagtctactggttgattaccccgaaagag

SEQ ID NO: 7652 - DNA, 308 bp, Triticum aestivum
  Clone ID: LIB3281-054-P1-K1-E8
cccacgcgtccggacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcaaaacgacgaggaccaggccta

SEQ ID NO: 7653 - DNA, 376 bp, Triticum aestivum
  Clone ID: LIB3281-054-P1-K1-E9
ggcagagtgaactgaagatgggtctgagctcaagcctagcgccagtggcatctgcactgctcttcttgtgctgcttcaccgcccggaatgctgccgctgccagtggtgatggtggcggtggtctgaggctgaacttctactccgagagctgcccgagggcggagcagatcgtgaaggagcaggtgaggaggctgtacgaggagcacggcaacacggccgtgtcgtggctccgggccctcttccacgactgcaccgtcaagtcctgcgacgcgtcgctgctcctggagaccgacgccgccacgggcctcgtctccgagcaggcctccccgaggagcttcggcatgcgcaactttaagtacgtgggcgccatcaagtc

SEQ ID NO: 7654 - DNA, 332 bp, Triticum aestivum
  unsure (1)...(332): unsure at all n locations
  Clone ID: LIB3281-054-P1-K1-F1
cggacgcgtgggnnntttttttttttttttttttttttcctctaaagcaaccattacattacactaaacaccacccacgatacataaacttgcctagcagaaccgaaaccctaaacaagggaggatgaggcatccttttgtacagccccttgaacaccaagcactcctaagaccagatatcggataggatcagatcaggcggcggcgaccttgcgtgccttcttggcggccggggagcggacggtcttcggcttcgccttggccttggccgccggcgactttttggccttggtgaccagctttttcttctcgggcgccttgcgcttggtgcc

SEQ ID NO: 7655 - DNA, 383 bp, Triticum aestivum
  Clone ID: LIB3281-054-P1-K1-F11
cccacgcgtccgcggacgcgtgggcgacctccgatccaccaccaacacgacacgagctcttggcggaggaggagaaggtgtcggcagcttcgtcgtcgcggtcgccaggtagacgcaggcgcggggagagaggcggagatgagacggccgctcggcgcatgcggcagcagatccagcccggccgctgctttcctcctggtcgccgccgcgatctgcgcccagttcgccacaggactagctgatgatgcatctaaagacgagtcaaaaggtcacactggccaaacagttttgtttgtcctgctaggaattggtgcagccggtctgttgtcattcttccttttcaagtattggcagaagaagaaaagagaggaacaacatgcacg

SEQ ID NO: 7656 - DNA, 383 bp, Triticum aestivum
  Clone ID: LIB3281-054-P1-K1-F12
ggcgggagctcattaaggacggctgcagcgtcactttcctctccggtgtggtggtggcggaggcctttctgctcaagctctgcctcaaggtgcagggtgtggctggggtgccacattctgagctgcagaaggagctaaggatctgggcggttagctctatctcggtcttccagaaccagcaattctttggagtcctgctgaacatgcttgtaaaccctccgctgcctgtttattcactactgagtgctgatgatgagatcttggtgagagaggtcctttatgatgctttgatcttggtggattattcattcctcaatggagctgaagttgatcaagctgatagttcccttttgcctatttttgtgtcaagattggttataact

SEQ ID NO: 7657 - DNA, 161 bp, Triticum aestivum
  Clone ID: LIB3281-054-P1-K1-F2
cggacgcgtgggttttagcgtcctcttctcaagctctttgtggtgtgtgagttgaccaactttatatgttaatccagcatcccctcatcaactagggtggtgtagtaagttttacactcctttatcatgcatgaatgagtcataatgggcctttgagattt

SEQ ID NO: 7658 - DNA, 318 bp, Triticum aestivum
  Clone ID: LIB3281-054-P1-K1-F3
cccacgcgtccgggcgcggcggtgcggcggtgggtggaggccggcggcgggaggctggtactggacggcgggctggccacggagctcgaggcccacggcgccgacctcaacgacccgctctggagcgccaagtgcatcctctcctccccgcacctcatccgcaaggtccacttagactacatagaagcaggtgcaaacattataattactgcatcttatcaggctaccattcaagggtttgagtccaagggattttcgaaagaacaaggtgaaaatttactaacaaagggtgttgagattgcacatgaagcacgtgag

SEQ ID NO: 7659 - DNA, 371 bp, Triticum aestivum
  unsure (1)...(371): unsure at all n locations
  Clone ID: LIB3281-054-P1-K1-F4
cggacgcgtgggcggacgcgtgggtagagagagagacctcgcgacataagtcagttgtaccaccggcgatcgagccagtctctcccggctccggctccggcgcgccgctatccataccagaggtcctttccctgccgcccgcgggatacaacatacaaggatgaattccctctccaacctcctcgccccccgcgcgcgcccttccctcccgctcccgctcccgctccgcgccgccgncccggncaccagcagcgccagagcggcggcaccggccccgcgacggtggcggcagcgcgcgcggctgccctcgccggtctcggccgtggcggcggaggcgccctcggcagcgtcgctgattgatggcgaggaga

SEQ ID NO: 7660 - DNA, 128 bp, Triticum aestivum
  unsure (1)...(128): unsure at all n locations
  Clone ID: LIB3281-054-P1-K1-F5
cggacgcgtgggcggacgcgtgggcgcacgcgtgggcgcgcctctctcgcccttgccgccgccaccggcgncgncgccactcccctcgccgccgcagcagccgcagccatggggcgcatgcacagccg

SEQ ID NO: 7661 - DNA, 377 bp, Triticum aestivum
  Clone ID: LIB3281-054-P1-K1-F7
cccaaaccctcccctcccctcccctagcggatccacacctctccctcgcggcggcggcggcggccagagcgggaagcgaaaactcgaagcagcccccgagcggcgagcatggccagcgaaggcgagcacgcggcggcggcgggcgagcagacgccgctcaagaaggcgggcgaggcggagcagggcgaggagctccaggccccctccggctggaccaagaagcttaatcccactcggggtgggaagtttgaggttgcttttgttgcaccaactggcgaggaggtcaagaccaagagagctttaaccacatacctaaaagcacaccctggaggccctgctctttcagagttcgtctgggcaactggcaatactcccag

SEQ ID NO: 7662 - DNA, 378 bp, Triticum aestivum
  Clone ID: LIB3281-054-P1-K1-F8
cgcctcactccaaaccctagctccgcctccgcgcagccatcagccatgtcgtcgatgatgcaaccgcagatcatcctgctcaaggaggggacggacacgtcccagggccgcgcacaggtggtcagcaacatcagcgcgtgcacggcggtggccgacacggtgcggaccaccctggggccccgcgggatggacaagctcatccacgacgacaagggcaccaccatctccaacgacggcgccaccatcatgcgcctcctcgacatcgtgcaccccgccgccaagatcctcgtcgacatcgccaagtctcaggactcggaggttggtgatggcacaactacagtggtgcttcttgctgcagaattcatgaaggaagctaaa

SEQ ID NO: 7663 - DNA, 378 bp, Triticum aestivum
  Clone ID: LIB3281-054-P1-K1-F9
gcgagcggcatgccgtacacgaccaccgaggaagagatccgggagctgttcgaccagttcggccccatccgctccctccagctctcccgcttcccggactccggcaacttccgcggcctcgccttcgtcaccttcgagtcagatgaagttgccatgaaatctctggagcttgatggatccaaaatcggtaacaggtttatgagggtcgaaagatgcagggtaactgctagctcgaagaggcaaaagaagacagagttccaatccgatcctgagaagcctgatggctgcctctcagcttatgtcggcaatctctcatggaacatcaccgagaaggacttgagggatttcttcaaatcatcaaggattgcatcaataaga

SEQ ID NO: 7664 - DNA, 394 bp, Triticum aestivum
  unsure (1)...(394): unsure at all n locations
  Clone ID: LIB3281-054-P1-K1-G1
cccacgccgnntccgcggacgcccgtgggtggtctgctttgcttcgatgcatttatgctcttcacggtgggtgtgcgaagttcgtattttaacccagttgtgttctttcggttcggcccatgtggtttggtggaaataggttcaaagggctgtcaaaagcattacanannaggggcagcagtgaatggtggctacccaacaaaatnngctgttatgttcagatgaaattgatcagccccttgaaaggaaattttgctttgacnaacttnaacaagagctatgttacagaaaaaggtattattcattgtatttggatgaagcatgtgtgtgaaaagttgcccagagggattgggaagaatgaacggccctgcacacacttggtgttgtgaacact

SEQ ID NO: 7665 - DNA, 386 bp, Triticum aestivum
  Clone ID: LIB3281-054-P1-K1-G10
cggacgcgtgggtttttttggagccacaaagatggttcatcattcataaagctctctcaattcttacactgcaatgttacacactaccactgatactactactaggataaccgctactactactacttgggtaacatcacagctgctactaggcaacaagaaagaacaaagccgctaagctggcacgaagaacagcagcagctgctgcagctgcatcatcgttcattcattcattattgaagaactaatcagccggaaaaactaccaggaaagaacaagggggagcaggcagagacgccgcaacatctctgcctgcatgcttgcttgctagacaagcagcaagcgagcaaatcactcacactctggatctcctctcatctctcttt

SEQ ID NO: 7666 - DNA, 387 bp, Triticum aestivum
  Clone ID: LIB3281-054-P1-K1-G11
tggtcgccggaagcagcgccccacagtcggacaatcgtcagatccggcgccgccgacgccacgatgaacgacaccgatgtctccaagcagatccagcagatggtgcggttcatccgccaggaggccgaggagaaggctggcgagatctccgtctccgctgaggaggaattcaacattgagaagctgcaacttgttgaagctgagaaaaagaagatcaggcaagaatatgagcggaaagagaagcaggttgatgttcggaagaaaattgagtactctatgcagctgaatgcttctcgcatcaaagtgcttcaggcccaggatgacctggttaataaaatgaaagaggatgcaatgaaggaactcctgaatatcagcagcaaccaccat

SEQ ID NO: 7667 - DNA, 340 bp, Triticum aestivum
  Clone ID: LIB3281-054-P1-K1-G12
ggcgtcttcacaaacgccggctcgctctcgctccgtctccctcccggctcccccgctccgcgccctacgccgacagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgagcggtctacgtcgatcttgagcccaccgtgattgacga

SEQ ID NO: 7668 - DNA, 306 bp, Triticum aestivum
  Clone ID: LIB3281-054-P1-K1-G2
gtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggggtaacaccatgaaccttgtcaatgacctcatcaagtgtgggggcatgaaaggcattacagtagaaaaaccttatattgtaattgaagagaatggttcaatgagacgtgcacctgctccaaaaa

SEQ ID NO: 7669 - DNA, 267 bp, Triticum aestivum
  Clone ID: LIB3281-054-P1-K1-G3
gcatatggtcagagtgctccggcaggaccagggtacagtcagcagggcggctatgcgcagtatcctgcgtcgcagccagcatacggtgatcagtcagctcaaaacaacgcaaactatggctatcagggagccccagctgatcccagctatggaaatgcctacccacagtcaggatatgctgctgcaccgacaactggtcagcctggatatggtcaggcaggatacacccagccaccagctacaaacccaccaagttatgatcagtct

SEQ ID NO: 7670 - DNA, 178 bp, Triticum aestivum
  Clone ID: LIB3281-054-P1-K1-G4
cgtccccatatcctcaaagtactcttacaagaccagtttacattcactagggcggctgtgctcattatcctccataccaaccatcatacatttatcatccagttcaaaacatcgcaaactttctatattatggatccccaaattatcccaactttttaaatgcctacccacattcatt

SEQ ID NO: 7671 - DNA, 349 bp, Triticum aestivum
  Clone ID: LIB3281-054-P1-K1-G5
cgcggcgcccgatctcgtcgtacttggagccttggaggagactcgaaccctagggccctcccgccgcaggagagatcccgctcagcctcggctccaatccgcgactcgactcgactcgaagctccagctccgccgccgccccccgccgctgccgatggatccgaagctggtggaggtgacgcagctgatcgaccgcttcaaggcggccttcaaggccagcaatttcgacgtctgctcgaccctcctctcgcagctcaaggtcctcctcaccaagttccccagccttcccccggtgttccagcagacgcccaacgccgtggaggagctcaagcttgcgagggaaatttat

SEQ ID NO: 7672 - DNA, 121 bp, Triticum aestivum
  Clone ID: LIB3281-054-P1-K1-G7
cccatcactacaaaccctatctccatctacctacatatctcacccgggttttccaatatgcaacctatgctcatactgcacaagtagcgcacccccacctcccataacataacacaccttg

SEQ ID NO: 7673 - DNA, 133 bp, Triticum aestivum
  unsure (1)...(133): unsure at all n locations
  Clone ID: LIB3281-054-P1-K1-G8
cccaaccctacacaccccatctccaacaaccaacanaggggacgcggcgattccaagacncacccaaaccacacacagcccaacgagcacaccacgaacccccagaacaaaacacaacaagcaaaaaaaacca

SEQ ID NO: 7674 - DNA, 328 bp, Triticum aestivum
  Clone ID: LIB3281-054-P1-K1-G9
cggacgcgtggggatccatttccaaaaacaacatctgtagttgaatattatcacattcttccgtataaggagattttgtttgaactcctccacaggaaatggccttctgattctccactgaacgaacaatcacatcgacatggaaaaggttcattgcactctgtaatagatgaaaatgtggaagagcaagatgtgaatagcacgtctaagatgcaaaaacgaattacaaaagtgtcaactccaaagcaaagcaaacaagcaattgctgccaatagcaaccaggactacaggaccagcaagcacaagagaaacagcaaaagaaaatctg

SEQ ID NO: 7675 - DNA, 341 bp, Triticum aestivum
  Clone ID: LIB3281-054-P1-K1-H1
ggagcacttccccatcctctcctacgccgacttctaccagctcgctggagtcgtggccgtcgaggtcaccggcggacccgaggttcccttccacccggggagacaggacaagcccgagccttctccagaaggccgctttcctgatgctacccaaggctctgaccacctcaggcaggtgttttccactcagatgggtttgagtgaccaggacattgttgctcttttttgggggcacactctgggaagatgccacaaggagagatccggctttggaggagcctggaccgccaaccctttgatcttcgacaactcttactttactgagctcctttatggggaga

SEQ ID NO: 7676 - DNA, 367 bp, Triticum aestivum
  Clone ID: LIB3281-054-P1-K1-H10
cggacgcgtgggcgaggtccagggcttccctaccctcaagatcttgaggaacgggggaaagaacatccaggaatacaagggccccagggaggctgagggaattgtcgagtacttgaagaagcaggttggccctgcttccaaggagatcaaggcacctgaagatgccacttaccttgaagacggcaagatccacattgttggtgttttcactgaattcagcggcactgagtttacaaacttccttgaggttgctgagaagctgaggtctgattatgactttggccacaccgtgcatgccaaccatctcccacgtggtgatgcagcagtggagaggccaatggttaggctattcaagcctttgatgagc

SEQ ID NO: 7677 - DNA, 253 bp, Triticum aestivum
  Clone ID: LIB3281-054-P1-K1-H11
tggacgcttttttcaagctcttggaaattccttaaatttaggaaccgggggatcgcggctccgcgcatatctacactcacccccccaagctatgcctatgacaattatccgtttttcccacaataaggcgagtgagttgtgttaatagagctgctggcttcgttgacggggtacttagcaaacatattctataaccctttggatgttggaaaaagtataatcatgtctcccgcgccggcgagataaaaaagat

SEQ ID NO: 7678 - DNA, 245 bp, Triticum aestivum
  Clone ID: LIB3281-054-P1-K1-H12
cccacgcgttcgcccacgcgtccgctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagcccttccacggccccattcact

SEQ ID NO: 7679 - DNA, 251 bp, Triticum aestivum
  unsure (1)...(251): unsure at all n locations
  Clone ID: LIB3281-054-P1-K1-H2
cggacgcgtgggcggacgcgtgggagaaaggaaaccccgaaaagaaaacagagcgggactccactccacactccactctcctnccccctcctcactctttcttggatcgtaaggaaacggaagaaatacatccgcgatcggggaggggacattttgatcggggttggtttcccaaggccgagacgagggtacgtggtggtcgtcatggatcggggcctggactggaggaccgggagggaccaacagcggag

SEQ ID NO: 7680 - DNA, 293 bp, Triticum aestivum
  Clone ID: LIB3281-054-P1-K1-H3
ctttttcattttcattttttgcgggaagatcttgccctccctcacctaacatgtagtgaagcgccaaccacaagcttcttcagtaaaactccgaaaagatctttgcgatcccccctggatcgaggaatcggtgaatgggtccgggtgatcatgccggcgtccgttccgccgacgggcggctggaggccctgctctccggcggcggcggggcacggcgcatggcgttggccgcggcgcttgagctgcggctgctaacttcgctggccgcgccggccgtggtggtgtacatgctg

SEQ ID NO: 7681 - DNA, 385 bp, Triticum aestivum
  Clone ID: LIB3281-054-P1-K1-H4
ttcttattcttctccgccgccggccggccgccgcctccgcctccgcctctgcgtgcgcgtgaggtccattgatttgatccattcagttcctgggagaggagaagggaagagaagaaaagatgctgccttggatcttcagccggaagggcgcgtcgggcttctcctgggcatccaccgccgaccaggtcaccgccggcatctccgccgcagggctcaccgcaatagtcaccggggcgtcgagcgggatcggcgcggagacggcgcgggtgctggcggctcgcggcgcccacgtcgtcatggccgtccgcaacctcgccgccgccgagaccgtgcgccaagccgttctcgccgagacccccggcgcgagcgtggaggtgatggagct

SEQ ID NO: 7682 - DNA, 134 bp, Triticum aestivum
  Clone ID: LIB3281-054-P1-K1-H5
ttcttattcttctccgccgccggccggccgccgcctccgcctccgcctctgcgggggcgtgaggtccattgattaaatacattcaagttcttgagagtaggataatggaagagaagaaaagatgctgaattgga

SEQ ID NO: 7683 - DNA, 372 bp, Triticum aestivum
  Clone ID: LIB3281-054-P1-K1-H6
cgcaaccctttgctcgactcaaaaccctcgacaagcgctgtcgacctcgcacgggcgccgcaacaatggcgtcccttttcaaggacccgagcaagctgtcggtgtacagggaccggcggttccctgggacgcaggaggagtttgaggcggcgctgctggcgtcgctgacggtgtacgtggggaacatgtccttctacaccacggaggagcaggcctacgagctgttctcccgcgccggcgagataaaaaagatcatcatgggcctcgacaagaacacaaagaccccctgcggcttctgcttcgtactgtactactccagggaagatgctgaagatgcagtaaaatatattagtggcacaatgcttgatgatc

SEQ ID NO: 7684 - DNA, 370 bp, Triticum aestivum
  Clone ID: LIB3281-054-P1-K1-H7
cggacgcgtgggcggacgcgtgggggcctatcgatccagatccaaattgcctggtgagtcctgtcgatgggaaagttttgcggcttggacagctcaggggtccaggaaccatgattgagcaagtcaaaggcttttcttatcctgtttcttctcttcttggtgctagttcatcgcttcatgatgccacagaagaagatatttctggagagccaacagaacaaaatgtgcctgagagctcgaatgcaaaatcatggtggcgagtatctgtggcttcacctaaacttcgggatcgaacactgctgagcccgaagagggggatcttttattgtgtcctgtatttacaccctggtgattatcatcgagtacactc

SEQ ID NO: 7685 - DNA, 359 bp, Triticum aestivum
  unsure (1)...(359): unsure at all n locations
  Clone ID: LIB3281-054-P1-K1-H8
cggacgcgtgggcggacgcgtgggggcctatcganccagatccaagtggcctggtgagtcctgtcgatcataaagttttgcggcttggacagctcaggggtccaggaaccatgattgagcaagtcaaaggcttttcttatcctgtttcttctcttcttggtgctagttcatcgcttcatgatgccacagaagaagatatttctggagagccaacacaacaaaatgtgcctgagagctcgaatgcaaaatcatggtggcgagtatctgtggcttcacctaaacttctgtttcgaacactgttgtgcccgaagagggggatcttttattgagtcctgtttttacaccctgatgattatcat

SEQ ID NO: 7686 - DNA, 363 bp, Triticum aestivum
  Clone ID: LIB3281-054-P1-K1-H9
cggacgcgtgggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtccgcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagaaagtcgggtgtcgtgtcgtgtcttcccctt

SEQ ID NO: 7687 - DNA, 284 bp, Triticum aestivum
  Clone ID: LIB3281-055-P1-K1-A1
cgctccccccaccggccgatctccacgccaccgccggccaccttgtgtctccgcccgccagcaccacaccccgcccgaccgagccccccttttcccagacccgcgatgagctggtggtgggcgggcgcggtgggcgcggtcaaaaagctgcaggaccagcgggcggcggcggcggagcccacctttcagagcgtggggctcattctcggcttcacggggatcgtcggcaccttccttcttgacattcttccgcgcggcgacaccctgggcgggctctgggaggt

SEQ ID NO: 7688 - DNA, 337 bp, Triticum aestivum
  Clone ID: LIB3281-055-P1-K1-A10
cggacgcgtgggattttactgcaggcagcgtatcaatgcgcgcgggaatctcggtcttgtttgggccgattccttaacgagagcctagtcgaaagcgcccataaaaagagcaaatcgatttcggtatgggtacgctggcccctactaggggcggtaagcaaggcagagaccagggagcaggaccgcgaagggtcttcccatctcttcttgatattggctttgtccgagatgcccgggtcaccaaatgataattcaaatcgagattgtgtgaagtaaagatctttttcttgaaagcggatgtctcccttcaaaatatcatccatctaatttgttaaag

SEQ ID NO: 7689 - DNA, 253 bp, Triticum aestivum
  Clone ID: LIB3281-055-P1-K1-A12
ctgacgcgtgcgattacacttgaggctacgtatcattgatcgggggattgtcatttttgataggaccgataacttaacgggagctttataggatgcacgcttaaaaagagtaaattgctatgggattgggtacgctggtccttactaggggcggttaactaggctgagactatggaccaggacagtgaagggtatgtccatgtattaaggttattgactctgtccgacaaggccggtttagccaattattatt

SEQ ID NO: 7690 - DNA, 343 bp, Triticum aestivum
  Clone ID: LIB3281-055-P1-K1-A2
accaaatgtgtgtgctatgataattaaggttactaagatgaatggggtttctatagggccggacatatttcttatcgtcataaatcagtgatgcacagattatcttagctatattgtgaatcttgataaccccacgatgaacaaattttgcggcctgtatttgggtttattcaaattgttgcgaaatatgttcttccaggaaaagtcactacatcatatgtcctagataaatatttattgaacatttagttttccttatacatgcttatcgtgtggcataatgttattttgtgagcttaattctaccctgaatatacaaataattagtttggttatttttttt

SEQ ID NO: 7691 - DNA, 371 bp, Triticum aestivum
  Clone ID: LIB3281-055-P1-K1-A3
cggacgcgtgggcttttttttttttttttgttccaaacaaaccaatcagatgtacaatacttgtccggcaaacaaagcaaaggttcgacaacgtatgtttacgaaggatgttcatagagacggatattccaatctgagatcactgcagcctggtcaccgatgtaccagaatataccaggtaaactacagggcagcacagcagcaactccaggacctcgtgacggcaccgtgtttattcttgtatacacatacaataccatcatcagcctgctttcacttggatgtagctcctcgcaggctcagcacataagctaggaagggtggatttcataattaaaaacaagcactcataacccaaagatccgcagcat

SEQ ID NO: 7692 - DNA, 348 bp, Triticum aestivum
  Clone ID: LIB3281-055-P1-K1-A4
cggacgcgtgggtgcggggaaatgagctcgcactctgctaaggcgctcaaggagctatcaacagccattcggacaatgatcgtaccatctccagccaacatcaccatgtccgcagccatcaaagctgcaaaagacctcagaaatgaattatcagaggaagcagctctgttgcaagtgatgcatgtggctgttactgcgacacttctctcagacttggttacgacaatagtgaaaattgcagaaaccgctgataatctagcacggcttggccacttcaagaaccctgaaaaaactcagaaagatgtcgctatcaacattccgagcagataaagacgcaaatttccttcc

SEQ ID NO: 7693 - DNA, 315 bp, Triticum aestivum
  Clone ID: LIB3281-055-P1-K1-A5
catctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgaaccctctacggcttcggcggctaggccaccgacgccgggatcttcaagcaagcaaagagattagcagtatttgtctagggtacgtggtctcttcggtgttgtttgctctgctctgttcctgcttgatgtatcgggaccgatgtactagtaccaagactgaatgaaatggaatttgg

SEQ ID NO: 7694 - DNA, 294 bp, Triticum aestivum
  Clone ID: LIB3281-055-P1-K1-A7
cgctccccccaccggtcgatcttcacgccaccgtcggacacctggggtgtttgtccggcagcgggataccccttctgaccgagcccccctttttccaaacccccgattagcttgtggtgggcgggcgcggtgggcgcggtcaaaaaacggtaggacgagcgggcggcggatgctgagcccaccttccagagcgtggcgctcgtacttgggattcactgggatggtcgggacctaccttcttgttattctttcgcgcgactacaccatcttctgtccctggatagtgttcttttt

SEQ ID NO: 7695 - DNA, 369 bp, Triticum aestivum
  Clone ID: LIB3281-055-P1-K1-A8
accaaatgtgggcgctattattattaagggtactaaaaaaaatggggggattatcgggccgggcatatttcttatcgtcataaatcagcgatgcacagattatcttagctatattgtgaatcttgataaccccacgaggaacaaattttgcggtccggatttgcgtttatttaaacagttaacaacagggtagtaccaggaaaagtcactacatccttgggccggaccggggtttttattggatatacatacaatacttatacatgcttatcgtgtggtaggatgtatattctgtgaggctaatcctaccctgaatatacaagagattaggttgtttattttttttgctgtcataaaaagaccccgcaa

SEQ ID NO: 7696 - DNA, 213 bp, Triticum aestivum
  Clone ID: LIB3281-055-P1-K1-A9
acccacgcacgcgttttctgaactttttttatgtgatcccaatcccattgggtcaggcccttgccaatagcgaagggcaagacaaagcagctccatctctgaagcctataatagaaacgcctactatcaaatcgttcatccaaaggacccttactggaattgctctgtagatctatctaatactactaccacgcgtattaatggttatgtcta

SEQ ID NO: 7697 - DNA, 357 bp, Triticum aestivum
  Clone ID: LIB3281-055-P1-K1-B1
cccacgcgtccgcggacgcgtggcccacaccaactttccccgtgtgtctttcttctcggcggaggcgaacgacgaaccctagccgcgcgaggaacgccaagatccccaaggccggcgacgatggcggcggttcggtgcgcggcgaggaggctcggcggctctctgctccagcgaacgcaggcggcggtcgcggaggagggacgcctgctcgcgccaagcaggctcatgcgctcccgccagctcttcaccaaggtctccggcgagcgatcgcaggtggcggagcgacacctcctcgagccaggcagcctcatgcgctcccgccagctctccggcgagcatgctcgcaacatccagaag

SEQ ID NO: 7698 - DNA, 353 bp, Triticum aestivum
  Clone ID: LIB3281-055-P1-K1-B10
gcatcgccgtcccgggcgacgccggcgcccagctgctcgtctgcggcgggctcgtctccgacatggactgcccgctgcacctcgtgctcaggtacgacgtctgcaggaaccgctgggccgtcgtggcccggatgctctcggcgcggtccttcttcgccggcggcgtcatcgacggccgggtgtacgtcgccgggggctacagcacggaccagttcgaacttaactcagccgaggttctcgacccggtgaacggtgtctggcagccaatcgccagcatgggcgccaacatggcctcctcggactccgccgtgatcggcggcaggctctacgtcaccgaaagctgcgcgtggccc

SEQ ID NO: 7699 - DNA, 316 bp, Triticum aestivum
  Clone ID: LIB3281-055-P1-K1-B12
cccacgcgtccgcggacgcgtgggtgtccatccggtggttggagcacggggcaacgctctggtcgcgatggggttgagctgcgcaggagggggaggaggctggcgacagggaaccgggccagggaggaggcaagcggcagttgcggatgtggtcggtggttgagggagggtctccgactagagcagcaggagcaaggagctcgaggaagttcaggtttatggcttctcacggattgtgattctggtcatgctacctgttatgaaggctgaggcgagcatcatggagatgagcaggcgagtggctgatacagagagc

SEQ ID NO: 7700 - DNA, 363 bp, Triticum aestivum
  unsure (1)...(363): unsure at all n locations
  Clone ID: LIB3281-055-P1-K1-B2
cgtcgatcctgggggacaccatcgactacatgaaggagctgctggagaggatccggcggctgcaggaggagatggaggagccgcatgccggtccggcggcggcgccgctgctgagcgtgttccgggagctcaaccccaacgagatgctcgccaggaacacccccaagttcgaggtggagcgcaaggaggaggacacccgggtggagatctactgcgcggccaagccggggctgctgctgtcgacggtgagcacgctcgacacgctgggcctcgacatccagcagtgcgtcgtcagctgcttcaacgacttcgccatgcacgccttctgctcccagatgcanaaggagatgatcagcgcggacg

SEQ ID NO: 7701 - DNA, 363 bp, Triticum aestivum
  Clone ID: LIB3281-055-P1-K1-B3
cggacgcgtgggctctcactccagagcacttctgtagcaaatgggcaacctcaggctgttgcggatccgggctcgatttgcaagcttcaggctgatcttcccatcgccaggagacactcccttcagcgcttcctggagaagcgccgtgacagggtggtgagcaaagctccttacggcgccgggaagccattcgaaggcatgggagcatcttctgggatggaagcggtcgcggagggcaaggcccagtaaccctgaaagaagaaagacggccctgcccctgatgtttggaaggaaaggggcgtgtgttaactgatgtgatgttacaccgtagaatcatcatcggtcgtgacgataataatgatc

SEQ ID NO: 7702 - DNA, 61 bp, Triticum aestivum
  Clone ID: LIB3281-055-P1-K1-B4
cggacacgtgggctctctctaggaatcagatgctgaaaataagggggaccggaggataagg

SEQ ID NO: 7703 - DNA, 292 bp, Triticum aestivum
  unsure (1)...(292): unsure at all n locations
  Clone ID: LIB3281-055-P1-K1-B5
gcaacataaggtgcagctataggagtcggaggatgaaacggcggcagctccgacaagaaggcggtgccgccggaggaggaggaggaggacatagtagcgttactgagctgggggggttgcgattgcgagcctagaattaatccttatttttctgcttcggagcttgacattcaccatcatcatcatcttgtacagaaaccgcctatttattcgaagcattaataaacagcgatcgatgctaatttggcagtcaagnaaaaaaaaaaaaaagaaaaaaaaaaaaaaaaattaa

SEQ ID NO: 7704 - DNA, 151 bp, Triticum aestivum
  Clone ID: LIB3281-055-P1-K1-B6
cccacgcgtccgatcggacgctagggtttgttccttccaccgtcccctgtttgctccccaccccacccggccccagaggaagttcccgccctcatggccgtcgtcgcctgcttcggggaggctggcgagtgtaggaggaatctggtacttt

SEQ ID NO: 7705 - DNA, 223 bp, Triticum aestivum
  Clone ID: LIB3281-055-P1-K1-B7
acgctgatgcttccatcaaggagatgatccctccgggtgctttggtcatgctcacccccctcattgtcggaaccctcttcggcgtggaaaccctgtctggtgttctggctggtgcccttgtttgtggagtgcagatcgccatctctgcttccaacaccggcggtgcatgggacaacgcaaagaagtacattgaggctggcaacatcgagcacgcgaggtccct

SEQ ID NO: 7706 - DNA, 271 bp, Triticum aestivum
  Clone ID: LIB3281-055-P1-K1-B8
cccacgcgtccggatcagatccagcgagagagagagacagagaaatccccaatccaccaaaccctgacccacacccactaggagagatcggcgatggccgtcgagaaaatgcagtttgccatgccgatggccaccggcttcgagggatttccctacatcccgttccaggcggagaaggagcaggcgcaggcgttcggcagggccatggcggagccggagccggaggaggtggcgctcgtcatggtcaggacgaagccagaggcggcgatcc

SEQ ID NO: 7707 - DNA, 357 bp, Triticum aestivum
  unsure (1)...(357): unsure at all n locations
  Clone ID: LIB3281-055-P1-K1-B9
gcctcggccgccatgggattcatcatggagttcgcggagaacctgatcctgcggctgatggaggacccggagcagcgcgacgaggcgcagcgggcgcacgtctaccggatgaaggagcggtgcgagcgcaccaaggcggcctgggcgctcccgctccgcccctacgggttgtggaccttcgaccgcttcaactcccagctctcctgggacccccagatcagccaggccgccggccgncgcgacccctacgacgaccttcttggccgccacgccgggccctgcccggccttctttttttgagaaccgaattcggcattaaccgctaggaagtgtggttggaccggatctacccgggca

SEQ ID NO: 7708 - DNA, 358 bp, Triticum aestivum
  Clone ID: LIB3281-055-P1-K1-C10
gccgcccttgaggtttttaacttcactggtgctggaggagtcgcgcatggctatgtacaacacagatgagtcaattcgaggttttgctgaagcttctatggcaatcgcttatgagaagaaatggccattgtaccttagcacaaaaaacacaatccttaagaaatatgatggcaggttcaaggacattttccaggagatctatgaagctggctggaaatccaaatatgaggctgctggaatatggtatgaacatcgtctcattgatgacatggttgcctatgcacttaagagcgaaggaggctatgtttgggcttgcaagaactatgacggagatgtgcagagtgatttcttagctcaa

SEQ ID NO: 7709 - DNA, 142 bp, Triticum aestivum
  Clone ID: LIB3281-055-P1-K1-C11
ctgaaatccccatctcctcacccgaatccctcccctggggcctccgctctcttctccctaaggaacttacctatcctccccccgtcgtcatgattcatccaccaccgcctttcaaaccaaatccgctcatgggctccccaca

SEQ ID NO: 7710 - DNA, 353 bp, Triticum aestivum
  Clone ID: LIB3281-055-P1-K1-C12
cactccaccaccccaacccatccatccatcacagaagagagagagagagagagagacagaggagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctcttcctctacatcaccgtcgccaccgtcatcggctacaaggtgcagtcggcggccgacccgtgcggcggcgtcggcgtgctcggcatcgcctgggccttcggcggcatgatcttcgtcctcgtctactgcacc

SEQ ID NO: 7711 - DNA, 368 bp, Triticum aestivum
  Clone ID: LIB3281-055-P1-K1-C2
ggctgccatggcggccacgctcctccgccgggcgctccagctccggcgcgcgctcccctctccagcttccttgcgcaccctcctccccgcggcctccagccgcctcctctccgtcaccgcctccacccagcagaacaccgccggcaccgccatcgacctctccaacgacgagagccgccgccgcctagtcaacagtctgatgtacaggagcaagcagaggggcttcctggagctggacctggtgctcgggacctgggtggagcagcacgtccgctccatggacgaggccaacatccgctccctgctccagatcctcgacctcgagaacccagacttgtggaaatggcttactggtcaagagcaaccgc

SEQ ID NO: 7712 - DNA, 367 bp, Triticum aestivum
  Clone ID: LIB3281-055-P1-K1-C4
cggacgcgtgggcggacgcgtgggatcagatgctgggattcaacaattttccatgaaaagtatcgcatcactgctggattagggggtgctggtagtggaagtgaattttgtatatggtcattactatttctaaggtgcggaacccttgttagcggagatagttctgggagcgttcaattttgggataaccgccatggaactcttctgcaagcccacacttaccataaaggcgatgttaatgcactagcaactgtgcctagtcagaaccgggtattttctgcaggatctgatgggcaggtaattttgtacaaggcatcaaaaaatgagttcagtgctcataatgagaaggtggctgaagagcaaatgc

SEQ ID NO: 7713 - DNA, 368 bp, Triticum aestivum
  unsure (1)...(368): unsure at all n locations
  Clone ID: LIB3281-055-P1-K1-C5
cccacgcgtncgggttggctgggatgaatcaactgcatctgagaggcgcactcgtgtttcgatatgggagattgaaccagttgccacacctttttatatttgtccaccaccatttttcaggccaaaactttctaagcagccaggaatgccagatgatgaaggcgaggttgatagtgctttcaaaagagccatgccatggcttggtgatgactttgccctaaaagatgtccaaagtcaattatttccaggcctgagcttagttcaatggatggctatgcagcaaaattctcagatgctaccagctggtgccccagctgtgcaggcgccgttcttgaactacaatgcaatggcttttcatgatgggatgg

SEQ ID NO: 7714 - DNA, 370 bp, Triticum aestivum
  Clone ID: LIB3281-055-P1-K1-C6
cggacgcgtgggggcaaggacgccgaccacgccctgctcagcgacgtcgccaagaagtcccccggcggcacgttcaactcggtgcccgacggcgggaacgtgagcgcgcccttctcgcagctcctcggcgggctcctcaccatcgtcgcgcaggacgtgcagctgacgctgacgcccaaggcggaagatcccagcgccccggacctggataccatgacggtggcgccagggaccgactacacgcagaccaccgacggcgacacgggcgtcatcaccatcaagttcggcaccctcttcagcggcgagacccgcaaggtggccatcaacctcaagctcctggagagcaccttgacgacggcgtacgacgggt

SEQ ID NO: 7715 - DNA, 302 bp, Triticum aestivum
  Clone ID: LIB3281-055-P1-K1-C7
cccacgcgtccgcccacgcgtccgcagagatgaacaaaaagatttacaagatgggcaagtctggacaggagtctcacgaggcctgcactgagtttgacaggactgagaaggacatcaccccgatgggtggcttccctcactatggtgtggtgaagggtgactacctcatgatcaagggctgctgtgtgggccccaagaagagagtggtgaccctccgccagtccctgttaaagcagacgtcgcggttggcccttgaggagatcaagctcaagttcatcgacacctcatcaaagtttgggcat

SEQ ID NO: 7716 - DNA, 363 bp, Triticum aestivum
  Clone ID: LIB3281-055-P1-K1-C9
cccacgcgtccgctttcttgaaggagtttggtcttgcgggttccggctcatcaaccccatccaggccacctcaaggaaggttcatcgagagcagctcaacgcaatcccagcagccccaaggaaggttcatcgagagcagctcaacgcaatcccagcagccccaaggaaggttcatcgagagcagctcaacgcaatcccggttacctcaagacaggctcatcgacagcatctcaacacaatcccggtcacctcaagacaggttcatcgacagcatctcaacacagtcccggtcacctcaagacaggttcatcgacagcattttaacacaatccccgttacctcaagacaggttcatcgagagca

SEQ ID NO: 7717 - DNA, 361 bp, Triticum aestivum
  Clone ID: LIB3281-055-P1-K1-D1
atcctagctagtaggaaactgcatcaggcaggggtagggtaataagttctgttctactgttagatagctagagtttacactccagcatctgttcccatcttatattctgtaggatatctgcatattatattcttctgatacatacattcttcctcgccatcttgacactcctctaatcacaccgacttccctggtgctctgcaaagaacacaaggatctctcctcactggctcttctgtattttttggaatgaagaggccagtggaggttcaagaagccccccttcgatgccctttctccctcatctgtcaactaacttttatcttcgcacctcccctcccaccttaatttggtgcatatg

SEQ ID NO: 7718 - DNA, 298 bp, Triticum aestivum
  Clone ID: LIB3281-055-P1-K1-D10
cggacgcgtgggtgagaaccctggtcactaaatgctggtcgctcggtatctatagcgactagactatagccaccacgaagcgaccaagtagtgttggtaccaatagaccactagccaccaattttgtacctttatcaaccgatcaccttggtggctaaaactaatgtctctagtagtgataagagattaagtatgtattgaatgtctaatgattgcaactacaagtattatttcggtaacgctgtatttagaaatataaataaatatctaaggtgttgccctagcgagtagttcaact

SEQ ID NO: 7719 - DNA, 339 bp, Triticum aestivum
  Clone ID: LIB3281-055-P1-K1-D11
cggacgcgtggggaaaaggataatacatggccaaatttatacaggaaatagcatgtccttgaggcattgataatgacatgttatcaagtgagcatccagttgtgaaacatcaacctgaaaatgcattgtcaatgattttctgccagtggttaagcgcttttctacagaagatcgaatgtgcattgttttttattgttccatgtcaaaggcatgattagtgaataactgaatacattctttgttttaaaatgtgtttttagatgataacatactttcttttcacaaaataatatgcacattttgggttttatgtattcccatatatcatatattttttat

SEQ ID NO: 7720 - DNA, 359 bp, Triticum aestivum
  Clone ID: LIB3281-055-P1-K1-D12
cggacgcgtggggaaaaggataatacatggacaaatgtggacaggggatagcatgtccttgatgcattgataatgacatgttatcaagtgagcatccagttgtgaaacatcaacctgaaaatgcattgccaatgattttctgccagtggttaagcgcttttctacagaagatcgaatgtgcattgttttttattgttccgtgtcaaaggcatgattagtgaataacttaatacattctttgttttaaaatgtgtttttagatgataacatacttttttttttacaaaataatattcacattctgggttggatgtattcccattatatcatatatattttattaccacaggttataggga

SEQ ID NO: 7721 - DNA, 371 bp, Triticum aestivum
  unsure (1)...(371): unsure at all n locations
  Clone ID: LIB3281-055-P1-K1-D2
gatcgagccaagaagtttgcagtgcgtgagggagtgagagaatggcgggtggcaaagccgcgctcctggtggccctgctcttcctgagcctggccttggagacccagcaggcggacagcggcgggtacgaccccgccccgacgccgctcaccacgtcccacaggaagcggcgtccgtctccgccgcgccctcgccctcgccctctcccccgcccacctacacctnccacgccaacgccgcccccgtacactccgtcccctcctgagcccactccgcccccatacattccgtcccctcctgaacccacgccacccccatacgccccggccccgatgccatctcccttcctcgagcacggcgcggaagccgac

SEQ ID NO: 7722 - DNA, 296 bp, Triticum aestivum
  Clone ID: LIB3281-055-P1-K1-D3
acgttcagcgtgcgaggaagtgtgagaatgcccgttggcaaatccgctctacggggacccctactgttccttatcctggccttggagacccagcaaaccaacagtggagggtaccaactcgaaccgacgccgctaagcacatcccaaatgaagcgggaatagtatgggtcgggccaaacccctcgccatttgcaagaatgacctacacctgctagaccaacacaagcccaaaacacttccttccctcttgatcccactcatgccccatacattccaggagtttaagaacaaaaacc

SEQ ID NO: 7723 - DNA, 366 bp, Triticum aestivum
  Clone ID: LIB3281-055-P1-K1-D4
gaactcgccgtcgacactgagctcgcgcgtccttcgacctcctcttccccaatccccttgaccccccgcccctccctctcgcgcctccagcaccgcccctccggccctggctgcgtcgcctccgctggccttcgcattcccctcgccgacggccatgattgactgcccgcggctgcttcttgctgccgcgagctccgctcccggcccctcgtccgccgcttgccggaggttcaccaccgggtgcccaaccttctccttttcatgccgcagccgccttccttctttccctgtgcaatctgcatcctctggggcggggagccagtcgagcgtcgtggatgagccggaggccgtcgaatgggccatgca

SEQ ID NO: 7724 - DNA, 357 bp, Triticum aestivum
  Clone ID: LIB3281-055-P1-K1-D5
ccggcggcgaggaggacaggatcacggacacggacgtcaaggcgctcatactgaacttgttcgtggcgggcacggagacgacgtctacgatagtggagtgggcggtggcggagctgatccggcacccggacatgctgaagcgggcgcaggaggagatggacgccgtcgtgggccgggacaggctcgtctcggagtccgacctgccgcgcctcacgttcctgaacgcggtcatcaaggagaccttccggctgcacccgtcgacgccgctctcgctgtcgcggatggcctccgaggagtgcgaggtcgtcggctaccgcatccccaagggcacggagctgctggtcaacgtgtggggca

SEQ ID NO: 7725 - DNA, 361 bp, Triticum aestivum
  Clone ID: LIB3281-055-P1-K1-D6
cccacgcgtccgccttctccatacgcctcgcctttggagcgctcgtgaaggaagcctcgagacctctgccttctgctctcctcggctctgcatccgcgagagctgttgcattgctgctgcagctcgcgagcgcccgggtcgttagtagttcttttcaccgcaccgcagtccggatcatggagttcgacgagcgctgcctcaaggtccaggaccccaaatttgactgcctcctcttcgacctcgacgacactctgtacccgctgagctcggggatctcatcacacgtcaagaccaacattgaagcttacatggttgagaagctgggtattgaggagatcaagatcgagaacctcggcaacct

SEQ ID NO: 7726 - DNA, 355 bp, Triticum aestivum
  Clone ID: LIB3281-055-P1-K1-D7
cggacgcgtgggaagtggcagatcgagagatcaggcagcggccaggccactcctctccctcggccgcggagttgctcccgacgggccacccggacccatccgtcctcgagcgtctcctccgcctgctcgcctcccgtggcttcttctccgagcacacagctgatgacaatcggaggcggtacacgctgaccgccctgagcacttcgtgcgcgcccacgccggcgttcccgtccacgcctactacggccagtccacgccgacggcgatcagatgcaagcacaaccggctcccttttttccaccgggcgccccttccattccctttctccactcatccgacgacgtggactgggatt

SEQ ID NO: 7727 - DNA, 358 bp, Triticum aestivum
  Clone ID: LIB3281-055-P1-K1-D8
ggtggaagtcgttcttctcgtccgggtccgtggccatgtacatggtcctctactcgatcaactacctggtgttcgacctcaagagcctgagcgggccggtgtcggcgaccctctacctcggctactcgctcttcatggtcatcgccatcatgctggccacgggcacggtcgggttcatctcctcgttctgcttcgtgcactatctcttctcgtctgtgaaggccgattaagttcctcctacctgcgaggagcgaccattgaattgagaggtgagtaagcatagtggagtgggcattggaaagagtttgtagtcatcatcacagtcctagttcatccatcccaacttttggtatacatg

SEQ ID NO: 7728 - DNA, 319 bp, Triticum aestivum
  Clone ID: LIB3281-055-P1-K1-E10
gtgtccgataaatatacaccaaggaaggataatgatggtagcatcaaaatgtaaagaggttgaaagaattgacaatatcgatgcagaccaaaaatataagaggaaaacagctctatatgcagctggagcaaacaaaaatgaaacggttacaaaccacagccttcacctacgacgctgcctcgatcttctcaatggtttctaacctcgttttccttttccatcctttcatggtggccacgaggttaaccagcccaacaacctggctcttgctgtattctggatgagaccgtgcccagtggacatactccgtctctggcaa

SEQ ID NO: 7729 - DNA, 361 bp, Triticum aestivum
  Clone ID: LIB3281-055-P1-K1-E11
cttacatcaagctttctactcatcttcatcttctagcacttgttgttgctagctagctctagaggggtgagcttacttttgggagcatcgagcccggaacgcatggcggtgtcggtgctggccatcctgctcgccttttgtgccctggcgggggcgagcttcgacaaggagttcgacatcacctggggtgacaggcgcggcaagatcctcgacaacggccagctcctcacgctggggctcgataaggtgttcggctccgggttccagtccaagcacgagtacctgtacggcaagatcgacatgcagatcaagctggtgcccaggaactccgccggcaccgtcacgggctactacctgtcgt

SEQ ID NO: 7730 - DNA, 364 bp, Triticum aestivum
  Clone ID: LIB3281-055-P1-K1-E12
cattccccagcctagctgaaggcggcggcagcaagcgattccaggtccggctccggcggccggctctccctcggtccctttcctccggccggccctctcggcctccggcactcccctccgcgcatccggccctctcggcttctcctccggccccccctgcaggcgcccagcgccctccgacaagtgtcaatcagtagtgggtggaagtggagtggagacagggaggctcggcgtttggaggcaaaaaaagctcaaccggccggcgaggcgaaatcatcgaaacgcccccaccaaccccccaccaaccggccgaggccatggcggcggcgcagaagccggccaagcggctcggcggcatggcggg

SEQ ID NO: 7731 - DNA, 293 bp, Triticum aestivum
  unsure (1)...(293): unsure at all n locations
  Clone ID: LIB3281-055-P1-K1-E2
cccacgcgtccgggtgctgtcctggtcatggtcgaggagcttttgataaggaagatagatgacgaacccgagagctacaaggccaaggctgccaccgccctagccaacattgttgagtccggcattgatccagacaccaccgtggtgaacaaggaagggcacgtcctcacgtccaagtattgcatctataactttgtgtgcatgctcaagtgcttcgtacccgacgacttcaacctcagcatnatncgcctactactcgcgcttaccggatttcgcaagcccctggatgtcat

SEQ ID NO: 7732 - DNA, 361 bp, Triticum aestivum
  Clone ID: LIB3281-055-P1-K1-E3
tatccagcgcagaagcggtgggcgacctgctggagaggggatgaagaccttatgcgtctaaacagacctgtccccagacgctcgctcacaggcagaattgaccagagaaagcagttttgttgatctaccgggtagaaaataaaattttgccccgccatctttgcttggcggggtgtacattcgatattcgagtcatctagcgatacttttgtcaacaggaaaagaaaatggcgacttacatgtaattcagctttagaaggagctcagctgtgtacaaagaaaaaaaacccatagctttatagacttacagatcagcgagatgcaagatagtgggtgctttttgttctttcgatcaacgatc

SEQ ID NO: 7733 - DNA, 368 bp, Triticum aestivum
  Clone ID: LIB3281-055-P1-K1-E4
cggacgcgtgggggggcggtgtcgcaggtggtaactgacatacgcagaggcgaagctgaagacagagactcgagaggcttcgggaggacaggatcgcagtcgcagcggcgacgaagcaaagatgtcgtattcgaggtacaggagtcgttcaaggagtgtggactcgagtgatgttgagaaccctgggaacaatctcttcgtgactggtttatcatctcgtctaactgatcgagatctggagaagcatttctctacagagggagaggtgattgatgcaagtatagtacttgatccatggacaagggaatcacggggattttggtttgttaccatggctactcttaaggaggcagaacactgcatcaaat

SEQ ID NO: 7734 - DNA, 360 bp, Triticum aestivum
  Clone ID: LIB3281-055-P1-K1-E5
cggacgcgtggggccaaattcaccagaggaggttcagacccctgagtgcaaaccttatgccagatctcaagctcttccagaaactgtggtaacccctcccctcccatctctgtatgcatgcacagatcatgtgcatccagctgtgtttactcatgcttcacttccctcccacatggtctggctccctccctaccgaagaactgtttttattttttggaatgtatttttaatattgacatggtttgtcataattgttgtggttaggtgtaatatattgacatgtttatcataattgttagcatgtgaggacacctgtaagttgggttaagagcacccgtgaagctttgacgcataaagcat

SEQ ID NO: 7735 - DNA, 300 bp, Triticum aestivum
  Clone ID: LIB3281-055-P1-K1-E7
cggacgcgtgggccctgtgctcctcaatcaagtctacgggcctgccgttctagcccgccgccgcaccatctcctccccggcaccaccgcactactccctccccgcgccggggaccaaccccttcccgggccgccggaccatctttttccctggactaccacaccacctcactccccgtgccgtggcaacaccccctccccgcgccgacgtaccatcttctcccaagcaccaccgcaccacctcactctccgcgccgtggcaccaccaccttcccgcgccgtcacaccctcttcaaccacc

SEQ ID NO: 7736 - DNA, 269 bp, Triticum aestivum
  Clone ID: LIB3281-055-P1-K1-E8
cccacgcgtccgattcgccgtccatcgccgctctgcccccccacccagcgcgcggcttcccgcgatggcgctgtccgcgtcggcggcgtcggcggggaggggcgcgcgggccgagaaggtgcgcaggatcttcgagcgcttcgacgccaacggggacggcgggctcgaccgggccgagatggccaagctcgtcgtcgccgtcaacccgcgggtcaagttcagcgacgaccagatctccgccatcctcgacgaggtcttccgcacctacg

SEQ ID NO: 7737 - DNA, 301 bp, Triticum aestivum
  Clone ID: LIB3281-055-P1-K1-E9
cctccatcttctccctgctctgggtcaggatcgaccccttcaccgtcaaggccaaggggcctgacgtgaagcagtgcggcatcaactgctgatcgcattaagaactctggacattgtgcatagggagaagaacaatttggacgcaagttttgtattgtggatgtttttgttcatgctatgttttgtgtaatattttggtggccagaaatggtttaaacaagaattgaacagcgggccagactttggatgtcaaagaaaaaaaccgctggcaaaaaaaaaaaaaccctattgctacataatg

SEQ ID NO: 7738 - DNA, 361 bp, Triticum aestivum
  Clone ID: LIB3281-055-P1-K1-F1
cgccaaacccctcaatcatctcaattcgaccgcggaaccctagaggtccgccagagatccgtccatcaggccagccactgatcccctcctcgatcagcgagtaccaaatccgcccccttttggaggggaggcgctgcccccgatctacaaattccagcagacagagcatcgtcgatcttcgtcaaccgatcgagggccgcaatctgggtgaagaagaagctaggtccggcgacatggggaggcctctgatgtacgagatagtggagaagccggcgagcagcggcgtgatagccgtctgctccctcatctggttcctcatccagaagaggggcatcgggtacgcggacgtggggctgagcta

SEQ ID NO: 7739 - DNA, 342 bp, Triticum aestivum
  Clone ID: LIB3281-055-P1-K1-F10
gtctcgccctcgccccccgtcccctcttcggcgcccgggctaagggaagatgagtcgtggccggagtgctcttggtggtcaaagttctctgggttacctgtttggagatggtgagcctgcaaagcccgctgcagcaccagctgccaagcccgcacctgctgagaaaccatcaccggccggtgctgatgtaaccaagcagattccagctggcattccaggtagccgggcgaacaactactaccgtgcagatggccagaacacgggcaactttcttactgaccgtccttcaaccaacgttcatgctgttgctggcggtggttcctccctgggctacttgtttgg

SEQ ID NO: 7740 - DNA, 363 bp, Triticum aestivum
  Clone ID: LIB3281-055-P1-K1-F11
cggacgcgtggggcatcacagacaatttctccgaggagcgcatcattggccgtggtcggcatggactagtctacaagggagtgcaggacaatggggtatgcattgctgtgaagaagcttcacctcatgtcggggcttgacgacgaggaattcaaaaacgagtttaataatcttatgagggtccgacatcaaaataccataccgttggttggttactgcaatcatacagcacaggtgcttgttgagcacaatggaaagcatgtttctgctcgaatagaagaaagatatttatgctccaaatacttggagggaggaacccttgacaagcatctttctaatgaaccatgtgcgtttgtctggcaca

SEQ ID NO: 7741 - DNA, 352 bp, Triticum aestivum
  Clone ID: LIB3281-055-P1-K1-F12
cggacgcgtggggacctagatcccctcctcccctcccactctcactcccctccggctcctccgatggcggccacgcctcacccggtgaccaccctcgacgacgtggaggagctgctgcggtcctctaaggagaagggggaggaggtcccctgctgccaactcgaggcggacgcggccatcaacgccgccgtcaagctcaaggccatggtcgactccggcgccgtccgcctcgtcaaccaggtgatgctggccaacaagctgcaggccaaggccaccgtggaagaagggttcaaggagatcatcgaccggacgctgttcttgccccgggagatgcatgcgctggacgagagca

SEQ ID NO: 7742 - DNA, 366 bp, Triticum aestivum
  Clone ID: LIB3281-055-P1-K1-F3
cggacgcgtgggggactgagctcctctcatcagcgtgcgacgaatgtccgcccgatcgaatctccagggtgataacagggatggctactggtagtgatgctggaaagtccgctgaggcagtgttggagtggcctaagcaggacaaaaagaggatgctgcatgctgtttaccgtgtgggagatctcgaccgcaccattaagtgttacacagaatgctttgggatgaagctgctgaggaaaagagatgtcccagaagagaagtacaccaatgccttccttggatatggacctgaggatactaattttgcacttgagctgacttacaattatggtgttgacaagtacgacattggagctggctttggac

SEQ ID NO: 7743 - DNA, 369 bp, Triticum aestivum
  Clone ID: LIB3281-055-P1-K1-F4
gcaggacttacactcttaaggtgaagagttcaaataagatcgaggatgtcgaggctaaaatgcatgatcaccatctagatgtgcagggtcttatctttgctggcaagaagctggtgtatggccgcaccctggcagattacaacattaagaatctgagcaccctacagcttgtccttcacctgcgtatttctgtcaagacgctgactggcaaaatcattgatcttgcggttaagagttcagataccatcaagcacgtcaaggcgatgattcagagtcaggagaacattccttgggataagcagggtctcatctttgccggcaagcggctggaggatggccccaccctggcagattacaacattgagactt

SEQ ID NO: 7744 - DNA, 370 bp, Triticum aestivum
  Clone ID: LIB3281-055-P1-K1-F5
cagcaacaacctcgccaagacaagtcaacatcggcggagagagaaagggagaagcgagaagatgtcgggccgcggcaagggaggaaaggggctcggcaagggcggcgccaagcgccaccggaaggtcctccgcgacaacatccagggcatcaccaagccggcgattcgtcgtctggctcgcaggggcggcgtgaagcgcatctcggggctcatctacgaagagacccgcggcgtgctcaagatcttcctcgagaacgtcatccgtgacgccgtcacctacaccgagcacgcccgccgcaagaccgtcacggccatggacgtcgtctacgccctcaagcgccagggacgcaccctctacggattcggaggc

SEQ ID NO: 7745 - DNA, 370 bp, Triticum aestivum
  Clone ID: LIB3281-055-P1-K1-F6
ctccaagagcctccaggaaagagagagagggagagatcgatcctgcgctgccaagatgttcatcgagagcttccgcgtggagagcccgaacgtgcggtacggcgcgggggagatcgagtcggagtaccgctacgacacgacggagctggtgcacgagagccacgacggcgcctccaagtgggtcgtccgccccaagtccgtcaactaccacttcaagaccaacaccaccgtccccaagctcggggtgatgcttgtggggtggggcggcaacaatggctccacactcatggctggggtcatcgccaacagggaggggatctcatgggcgaccaaggacaaggtgcagcaggccaactactttgggtccctc

SEQ ID NO: 7746 - DNA, 304 bp, Triticum aestivum
  Clone ID: LIB3281-055-P1-K1-F7
gaaagattcagccacacagccaaaagtgaagtatttcactcaggtgaaagcgcggccaccaacatttgtcacctttatgagtgggaagactgagctatctgatacagatatcaggttcttgacaagatctctcaaggaagatttcgacatcgggggaataccaatcccgatcctacagcgttctattccaagaaaagtgtcgtctttcaagagcaatatcaagaaaagaggatctagtataaaaaggatgaaaacagacaaaagaacagaagtgtctgatcctacccagtcatgattttacaat

SEQ ID NO: 7747 - DNA, 356 bp, Triticum aestivum
  Clone ID: LIB3281-055-P1-K1-F8
gtggatattgcagtattgatcttagttcaattcattctattacgtagcctcactttgttatccatgatttccctcatttgattgatttgacacatgttcattcactagattatagtctacttcattttttgtgtctttagttctaggttgttttgatttaagtggtacttgatttcttggcattgttcattgtctcgagccatgtctgaaactgaaggaaagaaggccctgaccactctcatcatttactcaagtaataacaccatcggcgacaggaacgacaagctgacgcagatcgtttcttggtggctgctaatgaatcatgtaatgattgcgcagaactcaccagaggaaaa

SEQ ID NO: 7748 - DNA, 354 bp, Triticum aestivum
  Clone ID: LIB3281-055-P1-K1-F9
gtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagattccagctggcattccaggtagccgggcgaacaactactaccgtgcagatggccagaacacgggcaacttccttacggaccgtccttcaaccaaagttcatgctgctcctggcggtggctcctccctgggctacttgtttggcggaaagtgatg

SEQ ID NO: 7749 - DNA, 365 bp, Triticum aestivum
  Clone ID: LIB3281-055-P1-K1-G1
cgccgcccccgagctccaccgcctcccgcgacgacgacgacgacgaccgccgccaagatgcgatgtgggagaggcggacgcacgcgaggatcctggtctcggacgccgacgcgggctgcatcatcggcaaggccggctccgacatccacgccatggaggcccgctccggggcccacatcaagctctccgggcgaggccggcccctccccggcacggaccgcagggtcgtcctcgtctccggcctcttccgcaccgtcatggacgccgcagagctcgtcctcgagaagctcttctacctgggcgaccaggtgattgacgctgaggccaccgtggtgctcgtggtgcccgacgcctgctgcggcgcg

SEQ ID NO: 7750 - DNA, 363 bp, Triticum aestivum
  Clone ID: LIB3281-055-P1-K1-G10
ctttctctctccacccaaaactgaatccccaaagcgccagcgacagaatcacgcgacgacgcgaatcttcgtcccgtaaaccctagcgcggtctaccctcctcagcccggagccgtctccgtcgcctcgcccaccggattccccgacgagggttttgggagggtggtgcgccgcccctgccgtccggggatagcctgcgcgtctcgatctcgggggagctagggttttgtgatctgaggcctcgaggtcagcggcgtcgccctggttctgatgagaattggcagtctaatgctcagattggccgccggcgacgacgagaggagcagcttcgttggcagcggcggcggaggcctcaggttcacc

SEQ ID NO: 7751 - DNA, 70 bp, Triticum aestivum
  unsure (1)...(70): unsure at all n locations
  Clone ID: LIB3281-055-P1-K1-G2
cacgccgnntccgcggacgccgnttgggagaccagaggtgtatgaggatgtgctagctcgacaaagcatg

SEQ ID NO: 7752 - DNA, 158 bp, Triticum aestivum
  Clone ID: LIB3281-055-P1-K1-G3
gcgaagtgagagatcagttttcgatttcgattccggttccgcttagagaaggccccagactagctagcgatatggcgaccggcgcgtgggtgatcaagtgcaaagccccggtgtcttggaaggcgggaaaccctttgtcaatgaagaaggtgaaggtg

SEQ ID NO: 7753 - DNA, 344 bp, Triticum aestivum
  Clone ID: LIB3281-055-P1-K1-G4
cgagaaatctcaatctccatctccaaaccgtagcagcagcagcacccctccttgccgacgaccccccagccccgatggcccgcacgaagcagacggcgcgcaagtccaccggcggcaaggcaccgaggaagcagctggcgaccaaggcggcgcgcaagtccgccccggccaccggcggcgtgaagaagccccaccgcttccgcccgggcaccgtcgccctccgtgagatccgcaagtaccagaagagcacggagctgctcatccgcaagctccccttccagcgcctcgtccgggaggtcgctcaggacttcaagaccgacctccgctttcagtcctccgccgtc

SEQ ID NO: 7754 - DNA, 369 bp, Triticum aestivum
  Clone ID: LIB3281-055-P1-K1-G5
gtcgacttgttgcacactgtgcaccatgagaccaaggtaaaagtgatgccttcagttgaggacctcttggaatattcatcgattcagaagttgcttttccttggcaacacggatgaagatttttctgtcctcacacggcattggtcggaactaacagaagggaaagcatgtgttatcaaagagcagccaaatgcaattgagattgttccccttaatgcttcaaaaggtggtggtataagggctctacttgatcatctcggattaactgaagattctgatcttgaggcggtcggagactataccagatggctaagcaacaagtgatccaactgacatgacgaagcattctttagcaagagagtgctgatt

SEQ ID NO: 7755 - DNA, 373 bp, Triticum aestivum
  Clone ID: LIB3281-055-P1-K1-G6
ggaaaggcgtcttcgtactcgcctctctccgcgcaaccgagcctgcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccct

SEQ ID NO: 7756 - DNA, 255 bp, Triticum aestivum
  unsure (1)...(255): unsure at all n locations
  Clone ID: LIB3281-055-P1-K1-G7
cggacgcgtgggcggacgcgtgggccggccgcagcagcagcagagagccagccgcccttcgctccccccagaggccagagacggacacgatggcggcgcccacctcctccgcggcatccaccctcgcccccttctcccaccccaaaaccctagccgccgccgccgccgncgcattctcctccgtcgccttctccccggccgcatcccaccccgcatgcgccctaaccccgcgccgcgcgggcgncggcatggtcg

SEQ ID NO: 7757 - DNA, 359 bp, Triticum aestivum
  Clone ID: LIB3281-055-P1-K1-G8
cggacgcgtgggcgcagcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaggtgccagctttgcaggatggtgacttgtacgtcttcgaatcacgtgctatttgcaagtatgcgtgccgcaagaacaagccagagctgttgaaggagggcgacatcaaagagtcagcaa

SEQ ID NO: 7758 - DNA, 174 bp, Triticum aestivum
  Clone ID: LIB3281-055-P1-K1-G9
ccgctcggttccttctccttcctccgagcttcagccatgggcaaggagaagactcacatcaacatcgtggttattggccatgtcgactctggcaagtcgaccaccactggccatctgatctacaagcttggaggtattgacaagcgtgtgatcgagaggtttgagaaagaagcc

SEQ ID NO: 7759 - DNA, 320 bp, Triticum aestivum
  Clone ID: LIB3281-055-P1-K1-H1
caaacgcaaactccgttcgttccccaccaccatctcgtccaaaacctagaaattcggagtgagattgtgttcgtccgtttgctttcgttttttggagatccgtgaggagggggagagacagatccgtcgcttgctcccagctcgaggtttgtgacgagcggattcgacgcgcgcctccgaagttcttcctggaactaatttgatgtgctatggaatccaagggtggtaaaaagtccagcagtagtcgttcctccctcatgtacgaagctcccctcggctacagcatcgaggacgtccgccctgcaggcggcattgagaag

SEQ ID NO: 7760 - DNA, 361 bp, Triticum aestivum
  unsure (1)...(361): unsure at all n locations
  Clone ID: LIB3281-055-P1-K1-H11
cccacgcgtccggtccatgtccatgtccatgcttcctcttcctgcgccctcactctcccgtcagatcccctctccccacttcttcctcgcccaaattccctctccccgaccaagcttcagctctgctctagccccagcaatgccgcctagctcgtagccgacgcgcccgtccgtccgtcgcaactcgcaatggcgcccgcggcggcgctgctgctggcgtgcgccgtcgccgcgctggcatgcctggcactcgcggacccgccggcgagcgagcagacggcgctgctggccttcctcgcggccgtgccgcacgagcgcaagctcgggtggagcgcctncacgccggcctgcgcctgggtcg

SEQ ID NO: 7761 - DNA, 149 bp, Triticum aestivum
  Clone ID: LIB3281-055-P1-K1-H12
tgaacgtcgtctcctcctacgggcccaactccctcggcgtcgtctacgacagaggactcatcggcaccaaccacgactggtgcgaggccttctccacgtacccacggacgtacgatctgctgcacgccgacggcctcttcgccgcaaat

SEQ ID NO: 7762 - DNA, 356 bp, Triticum aestivum
  Clone ID: LIB3281-055-P1-K1-H2
agcaacgcgaagcttctttgcttgagatagattgtgcttacacgtgaagaaaatgaactgcaagtcttctatctctctcttatttgctgcactgatcccctacatgttcctggtatttgatgcaagtcaagctgcagttccaacggatacccttcttcctggccaatctatctcgggcagcgaaattttggtctccgagaatggtgtatttgagttggggttcttctccccgtccccaggtgccatgaagcactacttgggcatacagtacaagaacctgataggcagccaccgagctatgttctggctggggaacagaatccctatcaccagctttctcaacacaaccttgtacc

SEQ ID NO: 7763 - DNA, 254 bp, Triticum aestivum
  Clone ID: LIB3281-055-P1-K1-H3
gtgacagagagaggtatagagagagagagagagagagggagaggggggaggggagaccctgaccaatgccaagaacaagaagagatcagtgaaaatccccaccggtcgagaggagacgagctccggcccccgttctccaagaacaagaacaagagcaagaaggaatcctgtagcacgagggaataaagcggcctgaggagaccgtaaaggtcgaggagaaaaaagctcctgcgacgatggagaaggggatggat

SEQ ID NO: 7764 - DNA, 375 bp, Triticum aestivum
  Clone ID: LIB3281-055-P1-K1-H4
cggacgcgtggggcaggactgcttcgcgcagctccacagcgcgcccgaccacccatgccccgggcaggagccgtccatgatcgtccggcaatccgccgacggcgccgaaaagaagagcttcgtcgccgtccccggcgaggtgcactactcctcccaggagtgcgcgtcggcgttcctctgccacttcttccacaagaagcacctcttccacaagaagtccgccttggtcgtccctcacctcaagaagaaggccatcgtgatcccgcacatccacaagaagccgatcgtgatcccgcacttccacaagaaaccggcgccggtgccggtgccggagtacaagccgccgacgcccaccccggtgtacaagcacccgac

SEQ ID NO: 7765 - DNA, 419 bp, Triticum aestivum
  unsure (1)...(419): unsure at all n locations
  Clone ID: LIB3281-055-P1-K1-H5
ggcacgccngggggtgcaggtccgggattgacggacgcgtccgcgcacgcgtccgcacaacctggctatgcgcgcggcacgtttacgcctggcaccagaccaactctcaatgctgatcaccttctaccgccatcgccggcagccaccagcgccgcgccgcgccggccgggcaccctccaccgaccggccttccacccacacctacccgcaccgacgggactcatgcttctcctccgcagagacgcacctccttcacaccgcgccgcccctgtgtggctaccaacctgctgccccgcgccagatcgaggaggcgccgctcagcaacggtgctggaagctacgcgcccgagatctggaacgcgcccggtcctccccgttggtatatttctccggcgccccctttcctgctgaccggcaccg

SEQ ID NO: 7766 - DNA, 370 bp, Triticum aestivum
  Clone ID: LIB3281-055-P1-K1-H6
aagcgagagtggacgttttttagaggatgcacccaactgattcatgggaggtggcaagagagcactcttttgtgccaggcacatctggagcgcgggcttcttcacatacccttatggaatacggtttctcacagggtcatgtttttctttgccatagcggttactgccttattggtgtcacaagcaaatgggtgaactgccctcattattgctactgttgtaactcataccacagaaatgtgttgttatactgtataaaacgatagcataactattgataaatatatgctctctgagcaagatcttttttgtgcagccacatttttacgactacacttggatatcttgccatagtgttagggtctgacta

SEQ ID NO: 7767 - DNA, 321 bp, Triticum aestivum
  Clone ID: LIB3281-055-P1-K1-H7
cccacgcgtccgctccctcaccctcccgcgccgcctcaacacggcgccatcctcatcacgaacccaccaaacaaacaaaaggcggacccaactccccctcctccaccttccccggagcacaaatctcccctcccaatccccacccccgtcggtagccaatcgcgtcgacgatgctgggcgccgcgaggagatccggatgcgtgctggggcaactgatgcagaccctccgcccggcggcaacggcggcgaggagctactccgcgaccccgaaggagatgactgtgcgtgaagcattgaattccgctcttgacgaggagatgt

SEQ ID NO: 7768 - DNA, 361 bp, Triticum aestivum
  Clone ID: LIB3281-055-P1-K1-H8
gctcctctgagtctgccctgcttgccaagcttggtatccgccccttctcttatgggctggtcatctgcaatgtctatgacagcgggtcagtcttcagccctgaggttcttgacctcaccgaggaagacctgatggacaagtttgcttctggtgtgtccatggttgcctcactgtccctggcgatctcataccccaccatggctgctgcgccacacatgttcctcaatgcatacaagaatgttcttgcggttgctttggagacagactactcatatgatcatgctgataagatcaaggagtacctcaaggacccaaaccaggttggcggtgctggccctgcttgttgcggctccgggggggg

SEQ ID NO: 7769 - DNA, 250 bp, Triticum aestivum
  Clone ID: LIB3281-055-P1-K1-H9
cacgcgtcacggctagtgtgagtttagtcctgcttgccaagcttagaagggggcggggggattatggactggtcatctacaaatgattatacacattggtaaattcctcaaccctgaggtgtttgacctcaccgaggaagacctgagaaataaattatcttctggagtgtacatggttgcctcactgttcttggcgatctaagcgacacttatgtcagacttggttaacacaattctgaaaacatacaaa

SEQ ID NO: 7770 - DNA, 83 bp, Triticum aestivum
  Clone ID: LIB3281-056-P1-K1-A1
acgcgtctagatgggggtgcatcgcacatttactgttttcttattgtcgcgcgaaggagtacgaagacccacctgctcaattg

SEQ ID NO: 7771 - DNA, 371 bp, Triticum aestivum
  Clone ID: LIB3281-056-P1-K1-A10
gccgccgacacgcacgaccaccaacggagccggaggaagagaggaggggagaagccaacaggtaacgatcgtgttccgctccggtgtgtccgcgcgtcgcgtggtggcggatgcgcgccaccacatgctgggtcgtcttgcgtcgatcgtggtcaaggagctgctaaacggacatcgcgtggaggttgtacgattcgaggagatgtgtatttacgggcgacttgtacgtcacaagatgaatgtcctgcgctctctacgcaagcggatgaacaataagcaccttggaggtgatatacatttccgagcagactaaggtattttctggcgtaaacggcgccggatgatcccacacaagactccccgcggagagg

SEQ ID NO: 7772 - DNA, 291 bp, Triticum aestivum
  Clone ID: LIB3281-056-P1-K1-A11
cccacgcgtccggcgagggactcggcaaaaccctaattttcacccagttcggcccttccaaaccctaaccctaatacgctcgatgttgtaatcccgccgcgtttgccatggctctagaggggcccgcggagcgacgggacgagggccagcagggagggatggcgaacgggaatggcgtggctccgccgccgtcgcgcatggccggccggccgttgggggcggctgcgtactctgacaggcggctgcgcctcaatccgaacacggagcacaagccgcaggactacaccgacg

SEQ ID NO: 7773 - DNA, 317 bp, Triticum aestivum
  Clone ID: LIB3281-056-P1-K1-A2
gcgggggcgggccacgcctacgcggacgcgtgggggggcatgcacatttacccttttctgattgtagcacgaaggagtacgaagaccgagcagtttaattggcgacaaacccggcaaaactccaagcactgggaaaaagaggttaaagaaggaagaagaagctggtgtctattggacactgctcgatgggttcggaaccttgatagggcgtacttcaagatgtggaacatttattgctctgggcgtcatccggagccgtttaaggtaaaagaagacgacagtgagttcccatatgacagatgaggagcatgaaataa

SEQ ID NO: 7774 - DNA, 314 bp, Triticum aestivum
  Clone ID: LIB3281-056-P1-K1-A3
cccacgcgtccggtccccctctctctccctctctcacaaacaaacaaacaaaccgctcttgtctcccattccaatctcgccccgtcggtcgaattacaagttagaagaagaagaagaggaatcagaggaagaagaagatggtgtctgcggtgcttcggacgatcctggtgacggtcggcgcggggtacatcggcagccacacggtgctgcagctgctgctccagggcttccgcgtcctcgtcgtagacagcctagacaacgcctccgaggaggccatccgccgagtacggcaactcgccaacgccccgtaaaac

SEQ ID NO: 7775 - DNA, 378 bp, Triticum aestivum
  Clone ID: LIB3281-056-P1-K1-A4
cagtggctctatggcaagtgggcccggtgggcgtggaccgacgtccggctcgtcggcgtcacgtggtactcgggcccccggcggtgcagctgttaagccccttccagctctgaaggacaatgtgaagaacgtcatgttctactgctgaagcccatgaaggcggagcttaaaatgctccttaagtcggcgtgtcgccccttgtcattgtaattatgtgaagaaagtagtaataatccgccagccgctgtctcgtgcgccgtactatgctggtctatgtttgcttaagtaccatctatgtgtgtactttgttatgttgtaaatgttgaatcttgagtactttttaagggcctggagcttgaaaacccgagcattcaagcc

SEQ ID NO: 7776 - DNA, 393 bp, Triticum aestivum
  Clone ID: LIB3281-056-P1-K1-A5
cggacgcgtgggcggacgcgtggggcacagtcctttcctagtccctaccacgcgccgcgcctctagctctcggccatgtcgtcgtccatggccgcggccgtgtcgtcgctccgctccctcccactccacacactcgtgccgctcgtggcctcggcgctcgccttcgtagtcaccgtcttccggcgcgttcttcggcggcagcggccggtgtacctgctcaactacagctgccaccttccggacgcggaccggcagtgcaacctggaggtgtgcgagtacttcggcctccgctccaagcgctacaccgacgagaccgccgacttcatgcggctcatcttccgcaagtccgggctcgggcaggagaccttcgcgccgcccttcatcttctccggc

SEQ ID NO: 7777 - DNA, 412 bp, Triticum aestivum
  Clone ID: LIB3281-056-P1-K1-A7
acgcgtacgcgtgggggtgcatgcacatttactcttttcttattgtagcgcgaaggagtacgaagaccgaccagttcaattggccacaaacccggcataactccaagcactgaccaataagcttaaagaagttcgatgaacctgtcctttatttgacactgctcgatggatacggaaccttgatatgccgtacttaaagatgtgcaacatatattgctctcggcgtcatccggagccgtttaaagtaaaagaagacgacagtgagttctccatatgacagatgacgagcatgaaatcccaggtgtggacatgaaaagcagagttgtagcgttgtacaatcatgtaactcgtttggctgctccctgtactgtaccatataatacacctttgcgtgtggagacccgacttatgt

SEQ ID NO: 7778 - DNA, 236 bp, Triticum aestivum
  Clone ID: LIB3281-056-P1-K1-A8
ggggtgatgaggacttggatattgtggatgcaagtgatgcagtggcaaatgggggtgatggttttgatcccgaggaaggtgaagcgaacaaagaggatggtgaggaaggtggtttggatcttgaagatctagaattgcctgaagcatagaccccataagctggtggaaatgctcgctgcactgtgtttgctactcctacaccaagaatgtctgtcaagcaaatttggacttaaaaa

SEQ ID NO: 7779 - DNA, 383 bp, Triticum aestivum
  Clone ID: LIB3281-056-P1-K1-B10
cggacgcgtgggcggacgcgtggggttgaatcgttgcatcaactcaagcacctgaggtatctggcactattaaacactgacatatctgttcttccagagaacattggcaagatgaagctattgcaatattttgaccttattggatgtaaaaatttggtgaatcttccaaatagcattgtgaagcttagccagctgaggttacttattcttcccacgtcaagtattgtacctagagggttcagcggtctgacaaatatgaggagactaagcgggtttcgagcccacatggatagcgattcatgcaacttggatgaggtggggcctctttcccaactcaaattttctaacttaacatgaatggaagaaggtgtcgcctgccctgt

SEQ ID NO: 7780 - DNA, 215 bp, Triticum aestivum
  Clone ID: LIB3281-056-P1-K1-B11
cggacgcgtgggcggacgcgtgggcacagagttcgattctggcgggaccacaccacgcacacaccaacacgcggtcatgtaccgggcggcggcggcggacatttcgcggtcctcctactcggcgctgaggcggcagctcgcgcgcggaggcggcggggagctatttcagtggtcccccgggtaccctactcaagaggtgatgcttggtgttggcg

SEQ ID NO: 7781 - DNA, 299 bp, Triticum aestivum
  Clone ID: LIB3281-056-P1-K1-B12
agacgacacggccatgccatgaaggttggagaggacaattgatgcacttgttgccggagttggcgtccttattttctcaagcaagcgtaggttcagtggaatgggagcattgtttttgaagggccaaggctgcatagtttgtacgcacatcaaagagaaacttggaatgtttttgtgcttggatctcgttcggaagtactacatcatgcaatacccaatggcgtcacctgatgagctccacgcgcagaggaagcgtcttcatgggttccccgaggaacaaccagacatttgaattgggt

SEQ ID NO: 7782 - DNA, 380 bp, Triticum aestivum
  Clone ID: LIB3281-056-P1-K1-B2
accgcagagatctgccctcccttccctccccccgagcgcgacggttagggttgggggacgccgacggcccgccggcatttctctgaaggcacacccagccaaacaagcccattagcgacttggcgacggaaaagaataacagtgggggttggatcactgagtttggcaaggagaataataaccctgagggttgggcgcactcttttgagcagcaatatggtaccaatggatgggtctttgagtttgaacaacatcagtcttagattgccatggatcagatgggaggggcgaacatagtgaatcttgcagctatgcagcaatcctgtatagcttgcagaaacattatctagtaacaatgacccaaaggtccagaattctaa

SEQ ID NO: 7783 - DNA, 334 bp, Triticum aestivum
  Clone ID: LIB3281-056-P1-K1-B3
gcttggcacatttgtttcaggctgcagaggacccacagtactcagtgatggcaaaagttgaactgaaaaaattgtttggaaagagaaccatcaaggaattgactgaaactaacctgtccgccaaccaaaagaagtcagcgatgaggaagctcaagtggagggttgttggagacactgaaagtagtcctgccccaattaccggtagaccggttgacaatcaagcccttgttgtcgagctggggcccatggagatacgcacattcttgctgaaactgtgagctgcaaaaaaaagagatacctttatgtaattccatacatgttctaagagatcatt

SEQ ID NO: 7784 - DNA, 399 bp, Triticum aestivum
  Clone ID: LIB3281-056-P1-K1-B4
cccacgcgtccggggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcactccacacgttcacgatccacgggctgtggccggactacgatgacgggacctggccgtcgtgctgccgccacaccagcttcgacatggacaagctaacgcccctgaagcccgctctgg

SEQ ID NO: 7785 - DNA, 212 bp, Triticum aestivum
  Clone ID: LIB3281-056-P1-K1-B5
cggacgcgtggggcccgggcggacacacacacgcacacacacataggttgggggacttgggggggttttttcaaaagaaaatcattttgggtgttgacaacaacaagaacaaacccgcgggggcaagaagttccccggcgcgtttggccttctgccccagcacatgaaggaccaacctgggggcggtgtgatcaccgggggccttatgccgg

SEQ ID NO: 7786 - DNA, 381 bp, Triticum aestivum
  Clone ID: LIB3281-056-P1-K1-B6
cccacgcgtccgcacaaatccttctaaggaaagcaatgaatttgtggagaatgtcctgaaagatattgagacgcttggggttaaatacgatgtagttacatacacatcggattatttcccaaagctaatggaaatggctgaaagtttgattaagcagggaaaggcatatattgatgatacacccaaggagcaaatgaggactgaaaggatggacggcgtggaatctaaacgtaggaacagtactgttgaggagaacttgtcgttgtggaaagagatggttaatggcaccataaggggtactcagtgctgtgtacgtggtaaacttgacatgcaggacccaaacaaatcacttcgagatcctgtgtactaccggtgcaaccc

SEQ ID NO: 7787 - DNA, 393 bp, Triticum aestivum
  Clone ID: LIB3281-056-P1-K1-B7
cggacgcgtgggatgggccgtacccagagatggaggagtactggaatcagtcccaaagtgctttgagatctggcccaatgcacaatgctgcaaataattggattagtgagttcggcaagcaaaacaataaccctgagggttggatcactgagtttggcaagcagaataataaccctgagggttgggcgcactcttttgagcagcaatatggtcccaatggatgggcctctgagtttgaacagcatcagtctcagatggccatggatcagatgggaggagcgaacatggcgaatctcgcagctatgcagcaatcccgtatgcttgcagaaacattatcaagtaacaatgacccaaagttccagaattctaaattcttccagtttgtttcaaaga

SEQ ID NO: 7788 - DNA, 370 bp, Triticum aestivum
  Clone ID: LIB3281-056-P1-K1-B8
tggctgctatacgtgatggcgtgggattatcagacagagagctgggatgtgattctgcacgttcagcgacagcacataagcagcattttggcccaacaaataagatgcaaagtgcctcacaatgttcagatagctttgcggggcacatacaagaagagaccagcggggcaccccacgactcgccgcgacatgagcaccgtacgaacagcccgctaagaggagtaagttctgctcaatctggcgggggcaaggagacaagagcacaacatgtccgaagcggggtgatctgccaaaggcgccaaggaagtcaacttactgctccagatgcaacctgacaagtcccagaaagaacacctgcaccaacacgccc

SEQ ID NO: 7789 - DNA, 375 bp, Triticum aestivum
  Clone ID: LIB3281-056-P1-K1-B9
cccacgcgtccggcatgaagcagttgttgagaattggtcaaacaaagatttcacattttcctacagtgtttactctggtgacttgtcaggtggtatccatgtgcagccttcaacatcacaggattatgacgatagagatacgttcagcattttcattttacctggaagtgggaatagaaaggtcttcaagaaagcagtcgtatttgttgttgatacaagtggaagcatgaaagggaaacctcttgagaatgtgaagaatgcaatgtctacagctttttcttgacttgtgcaagggggttacctcaaccatattacatttaatgaggaggttcattccttcttataaaggttaggggaaggtaattgaaaagccat

SEQ ID NO: 7790 - DNA, 297 bp, Triticum aestivum
  Clone ID: LIB3281-056-P1-K1-C1
acaagttctctaatgaatgttcttttccctctataatattgacccaacaacataaccatatggctctctcatataaaaacacactgttcttaacaatggaaaggcaaaatcattcaaccgctatgcaacttctaaaggcttcagtttttcgatgtacagtcttttcaagccatcaattacagaagtaacaccactcagaggcgtttgaatcttctttgcagatttggaactgaaccaactttttgtagaaggtgctttcaccttgagggtgccattttcttgtgggcgaactacatt

SEQ ID NO: 7791 - DNA, 234 bp, Triticum aestivum
  Clone ID: LIB3281-056-P1-K1-C11
aggcttcgtggcgcctgcatgcaacgtcataacttttatataggggcatttaaatgcaatccactgcccttttttcaacagcaagcagaatagcgacagcatggcgttacgcaactgaatccgctagaagcacattccactgacgccagcctgaatgataccgtagaggctctcgccgatcagctttcccagcaggtcctgccccttactgggcaatgggacgcgacctgtagt

SEQ ID NO: 7792 - DNA, 332 bp, Triticum aestivum
  Clone ID: LIB3281-056-P1-K1-C12
cggacgcgtgggattgcaatgcacctgttccaggatctgttttgcggcaaattctacttcctgtgctgatattggcctcactggccatgggtcaggcgacatgaacagaggatggtttataccacggtataacactagagggagtatttgttcacggacagggtagagcttttagcccgttagagatgtactttgttgggtgtatgtcgctgctgcagtatttgttttgcacttgttgattcttctacggtgcgagaattgatgatttagtgtgaaaatggaataaactgtctctgtgaataattctataatattaaataaaccgattgtct

SEQ ID NO: 7793 - DNA, 397 bp, Triticum aestivum
  Clone ID: LIB3281-056-P1-K1-C2
cacctccataccgatctcacccccaatggtggccacgcccacactcgccccccagccctagatcccattcgtttgcgcatggcggagcacgccgcccgccacctccgccgccgcggccccgtcgccggctggtgctgctccttcgccggcgtcccgcccagccccgaccaccgcctcccccaccgcaccctctcccacgccgccgcgccgcaaggaccagcagcaggatctgtgtgcaccggcggcgagggcccgcggaagcagcagccgccgccgaaatccccctcctccttccacggctcgccctcctccaagctggcgggcctcatcgactacccgcgccggatcctctccccgggccgcgtctcccccatcgaccccggcgcccacccgccca

SEQ ID NO: 7794 - DNA, 397 bp, Triticum aestivum
  Clone ID: LIB3281-056-P1-K1-C3
gttaccgctcgcacttgccactcaagtaccgcccccattctctctcatggcggactcctgctgcccagccaaaccctaatgtcgaaccggcggcgccgccacgccccccgcgccgtagcctcgccgccacgagctctcttcgaagattggaagctctcggcccggcgaggaaactaggagacgtaacgcctccgggagggaggcgccatgggcgatctgaaggagatgaagtacaggcggaggattgggctccaggagcgcgcgcaatgcagcgaccagagggccgtcgactggggcgtgctcaagcaggaccccgtggagctgctgcgcaagctggacgagctgagggaccaaatcacgcggtcctgccaggtcgccgagcagccacgggagcacc

SEQ ID NO: 7795 - DNA, 338 bp, Triticum aestivum
  unsure (1)...(338): unsure at all n locations
  Clone ID: LIB3281-056-P1-K1-C4
cccacgcgtccgcccacgcgtccgcggacgcgtgggcttccacatgatatagatttgttatggtaaatatttatattcttttctataaacttgctcaaactttagaaagtttgacttcagtcaactctaatatgcggagtaaataaaaacggagggagtattcaagcaagtctatttaaggttgtaaacatgctgatactgccctactntgtgatgtcaaatcatctccaaatgtatgtcctgaccaggcgatttctttgtccttggtcgcctggagcggtctgactcttgcaggaaagatagttcttaagcatccagatgtgcaggaagtactatac

SEQ ID NO: 7796 - DNA, 343 bp, Triticum aestivum
  Clone ID: LIB3281-056-P1-K1-C5
gtgtgtgtgtgtgtgtgtgtgtcgagctcaccaggaattccgcggcaggtagctggttgggtggaagatcgatcgacgggagagaaaacaggatcgagatgatgctcaaggatctcgcggcaattcataaataccaggaacataaaaactggccctggccgacgcaagaacatgtaaggcctaacacacgcctacactgaccaaaccagtgatgtctaataccctctaacgtcatgttccaagaagaagcacactctgccggtaaatccacaccctcacgcggactttatcacgctagatacgtgttcactcatcggaactaaccgatgcactatccagagct

SEQ ID NO: 7797 - DNA, 283 bp, Triticum aestivum
  Clone ID: LIB3281-056-P1-K1-C7
cggacgcgtgggggctctggtccaatatgagctcctggaaagtttgatttcaacaggtgcttaatgaatgttgttttccctgtagaatattgacccaagagcataaccattggcttcgcatcgaagtcactgttcgtcagcaatggagaggcaaaatcattgaaccggtatgcaacttctaaaggcttcagtttttcgatgtacagtcttttcaagccatcaattacagaagtaacagcagtcagaggcgtttgaatcttctttgcagatttggaactgaacc

SEQ ID NO: 7798 - DNA, 391 bp, Triticum aestivum
  Clone ID: LIB3281-056-P1-K1-C8
ctccaagaaagagatgataactctgaaatgtgctgcctgtggcttgctctctgatggtgacatgagggacaagctcactacattcatcctgaagaacccgccagaacagaagaagggaggcaaagacaagaaagctatgcgaagagctgagaaggagcggatgaaagaaggtgaaactgctgatgaggagatggaaaaactcaaaaaggatgcaaagaagaaaggtgcttcttccaaggatacaaataaaaaggctgctgggggaggttcggatgaagaacatgcaacctgaccaactcacaatcaaggtgctgacattgcagctgctggagatgatgatgacgatcacaatgatgatgtgcagtggcagactgacacatcaacggaagct

SEQ ID NO: 7799 - DNA, 387 bp, Triticum aestivum
  Clone ID: LIB3281-056-P1-K1-C9
tttttgtattcaataagaaggacaatgatgattctttgccagtctgccttgaagccaagccagtagaacgttctgcaggtgatatgattggactgggtggttccttttcaacaaaagaaaccgagattagatgtacaaaaggaacagaaactctttggtcagatcgcatctccggaaaagttactgtcttggctggtaatgcaaacttctgggcagttggctgtgaagatggctgcctgcaggtttacacaaaatgtgggatgcgagcaatgccagcgatgatgatgggctcctcggctgtttttatagattgtgatgactgctggaaattgttacttgtaacaaggagaggtttaatgtacatatgggatctcaataacaggacct

SEQ ID NO: 7800 - DNA, 396 bp, Triticum aestivum
  Clone ID: LIB3281-056-P1-K1-D1
cggacgcgtgggcaaaaacgcacgcctccgatccccacgccgagacggcagccttagacctagccaccacagccgccgtcggacagtgacctccgcggactccgcaggcacggggataagatcactcaaccccaggctgattgtggctgggaattatgtcatgaactaccttgcggcaagaggacctaaattgcagaacttcgtgactatttccctaattcagcttgcatgtcggataacaaaatttggatggtttgatgacgacagattcagagagatttttaaagaagcgacagatttcttagctctggcatctcaggatcactatttaataggattgaagatactaaattttctcgtaatggaaatgaaccaggcaaactctgcaatgccttt

SEQ ID NO: 7801 - DNA, 333 bp, Triticum aestivum
  Clone ID: LIB3281-056-P1-K1-D10
cggacgcgtgggtcctccaatccagcaccaccgccgccagctccacacctcgagagggacacctcgtcgccggagaagcagcaagaagaagatggccggaaggaagggcggcgacaggaagaaggcggtgacccgctccgtcaaggccgggctgcagttccccgtcggccgcatcgggcgctacctcaagaagggccgctacgcccagcgcgtcggctccggcgcccccgtctacctcgccgccgtcctcgagtacctcgccgccgaggtcctggagcttgccggcaacccggccaaagacaacaagaagacgcgcatcatcccgcgccacct

SEQ ID NO: 7802 - DNA, 189 bp, Triticum aestivum
  Clone ID: LIB3281-056-P1-K1-D11
gaacctttctccttctgtcccgcaaacccccgagagatcacagcatgttcggcttcggtcaccacggccaccatggccagaacccccctgccaacgctccggccgccggcggcggcaaccagcccaccttcaagatcttctgcaaggccgacgagggctactgcctctccgtccgcgacggcaacgtcg

SEQ ID NO: 7803 - DNA, 297 bp, Triticum aestivum
  Clone ID: LIB3281-056-P1-K1-D12
ctcccgccgcccccctccccctcccgctcccaaaccctaacccctccgcctctcatcgccgccaccgcggctctccccttcctcgtcgcgacatcccgtccccgccctctccaccgcgtccacaatcttcctccattagatttcgaggggtctcggaaggatggcgttcctgcagaaggtcgggaatgccctcaagcggtccgcgggctccggctcggcgatgctccaggcggtccggtccatgtcctcctacaaggtcttcgtcggaggcatctcgtacggcaccgatgaccagag

SEQ ID NO: 7804 - DNA, 401 bp, Triticum aestivum
  Clone ID: LIB3281-056-P1-K1-D2
cccacgcgtccgcccacgcgtccgcccacgcccgcccacgcgtccgcgcctcccagttcgagttccgccgccagcaccaaccgaagccaagtttcgaggccgccgccgccgaggagcagtagacgcgccgccatggcccgtaccaagcagaccgcccgcaagtccaccggcggcaaggcgccccgcaagcagctcgccaccaaggcggcgaggaagtcggcgccgaccacgggcggagtgaagaagccccaccgctacaggccgggcaccgtggccctccgggagatccgcaagtaccagaagagcacggagctgctgatccgcaagctgcccttccagcgcctggtccgcgagatcgcgcaggacttcaagacggacctccgcttccagtcccacgccgt

SEQ ID NO: 7805 - DNA, 299 bp, Triticum aestivum
  Clone ID: LIB3281-056-P1-K1-D3
gtgactacctcatgatcaagggctgctgtgtgggccccaagaagagagtggtgaccctccgccagtccctgttgaagcagacctcgcggttggcccttgaggagatcaagctcaagttcatcgacaccttatccaagttcgggcatggccggttccagaccactgacgagaagcagaagttctacggcaggctcaaggcttaggctgcgacagatcttatcccatagtgttaccagctttttttcttgctttgtggcagattgtttgggaaccggtttatgcattgcaattgcaactca

SEQ ID NO: 7806 - DNA, 378 bp, Triticum aestivum
  Clone ID: LIB3281-056-P1-K1-D4
gaccgctaacagcaaaccaggccgcatctcccacctatttacacacaaaaatcaccacccccccctacagggcgggctgctgctactatactctgacgggaaacccaaaattctggagtatcctgatctgacccccgctgcctgccgtggcgatggccatgccccaggccgaccggctcggggcctgcccggcggcgtcaccgtcggggagactggtgctggaccgcaggctctgtttcgtcggcgtcatgagctcctcgggccaggtcgcagacgctctgtcgccgctgtggttcgaaccgtcgcttaggtcattgtggctctgctggtgctgctggaaataagaggaatctccgtcaggatactcggacacacagt

SEQ ID NO: 7807 - DNA, 335 bp, Triticum aestivum
  Clone ID: LIB3281-056-P1-K1-D5
gaccgacaaaagtaaactaattcccatacctcacgtaccgataaggaggacagagaccgcgcgcgcagagaggagaagctgccggctcgactccttctccgtaaactgactactctggcggctccatacatccaccgagaggagagggcaggcggaggacgtaccaccggcggacgccagaggccgcacctacctacctatatatctatctatctatctaagccgaccgaatggactcggagcactgcatctcgcgcctggccgccgcaagcgatactacgcggcgcagctggggcacgcacatcgggcgaggatggacgagctggacatggact

SEQ ID NO: 7808 - DNA, 399 bp, Triticum aestivum
  Clone ID: LIB3281-056-P1-K1-D6
ggagaagcagtttgcagctgaggagatatcctctatggtcctcatcaagatgcgtgagattgcagaagctttccttggcagcactgtgaagaatgctgttgtcactgtacctgcatacttcaatgactcgcagaggcaggctaccaaggatgctggtgtcattgctggcatcaatgtccttcgtatcatcaacgagccaacagctgctgccattgcttatggtcttgacaagaaggcttccagtgttggtgagaagaatgtcctcatctttgatcttggaggtggtacctttgatgtctctcttctcaccattgaggagggcatctttgaggttaaagccacagctggtgacactcatcttggtggggaggactttgataacaggatggtcaaccactt

SEQ ID NO: 7809 - DNA, 391 bp, Triticum aestivum
  Clone ID: LIB3281-056-P1-K1-D7
gtttactggaagtaagcttgactgacaatacacgtaattcaatgcttgttcttctaactaaaaattcagttcatgattctggtcctatacttactgaaatgattactatagaggtcacaaagctttcaaattcaagaataaggagagtattttctgttttctttccgccaatttcttttcatataaatatgacatttattgtttatagttaatgggcttgttttagctatgcagttttcaacctatatgatttctggttattggataataaactttcatgtagctctcgactgcccacacatgtagctgtacaatttaatctctagatacatcatacatgcaaattctttatctccctgtctccttctataggtacctaaaatacttgaca

SEQ ID NO: 7810 - DNA, 441 bp, Triticum aestivum
  Clone ID: LIB3281-056-P1-K1-D8
gtgccggtcccgaatcggagtgtcggcctacacctacgcgtactacttaatgatcaagggctgatgtgtgtgcccacaagaagagggtggtgacccttcggcagtccctgttgaagcagacctcgcgggtggcccttcaggagatcaagctcaagtttatacacaccttattcaagttcggtcatggacgtgtacagaccactgacgagaggcagacgttctacggtaggctcaaggcttaggctgtgacagatcttataccatagtgctaccagctttttttattgctttgtggtagattgtctgcgaaccatttaatgcattgcgatcgcccctcaagacaacaatagtgttgacataaacaatgcgctccctacacttgcccacgcacaagaagcctctcatcttctcagacatggggctgccgttctagaggatcca

SEQ ID NO: 7811 - DNA, 377 bp, Triticum aestivum
  Clone ID: LIB3281-056-P1-K1-D9
gttcgtggtcgcgcccagcaccaggctctccaccttcaacgccggccagtacctcggcatcctcaacgtcacggacaacggcaagcccgacaacggcgtcttcggcgtcgagctcgacaccatgctcaacccggagttccaggacatgaacagcaaccacgtcggcgtggacctcaacagcctgcggtccgggcagaaccactccgccgggtggtacgacgatgccacgggcgtgttcaacaacctcagcctcatcagccgccagcccatgcaggtctgggtggactacgacggcgccaccacccggctcgacgtcaccatggcgcccctcgacgtgcccaggcccaagaagccccttattttcgcgcccgtcaacc

SEQ ID NO: 7812 - DNA, 394 bp, Triticum aestivum
  Clone ID: LIB3281-056-P1-K1-E1
cccacgcgtccggtacagtactaaacttgtacaattcttgtcttgtttgcacacaacattaagattagagtcgtgctttctgaatgttgagccgatttttatggcctgtgtgctagcaaactgagctaagggtgcttcatctttgtccttcagcttctattcttatgacaattaaatagaggatctattttgctccctgctctgattggtttcaaccgatatttatctcatccagcactctgagtatcaatgtgttgttttaatcctgatgatgacgtggtagtatgaagtggacaccatattcctgtttaaatgcacaaggaataatttgtttcatcatgtcctggtttatccatgccagatttgttgcttccggaactcttggtccttcata

SEQ ID NO: 7813 - DNA, 399 bp, Triticum aestivum
  Clone ID: LIB3281-056-P1-K1-E10
tccagttaagtcgcctttcgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgggagatcgcgcaggacttcaagacggacctcaggttccagagccacgccgtgctggccctacaggaggcggccgaggcgtactctgtggggctgttcgaggacaccaa

SEQ ID NO: 7814 - DNA, 349 bp, Triticum aestivum
  Clone ID: LIB3281-056-P1-K1-E11
ccactcgttcgtcccgtcaacaagaggagcagaggcgccggagagggaagagggtgcgcgcgctcgcgtgtgtggtgtccgccggcccgatctgccctgctcccgccgcctcgaccaccacccctatcagcaacatgggtgccggcggcaggatgacggagaaggagcgggagaagcaggagcagctcggccgtgccaacggcggcgcagcctaccagcgctcgccgacggacaagccgccgttcacgctgggtcagatcaagaaggcaatcccgcctcactgcttccagcgctcgatcatcaagtccttctcctacgtggtccatgacctggtcatcgtcgcgggcct

SEQ ID NO: 7815 - DNA, 388 bp, Triticum aestivum
  Clone ID: LIB3281-056-P1-K1-E12
cggacgcgtgggccttgcgctgaacgagaaggtgctcagcttggccaaggggttcatggataaaggaaagccggtcgcgtcgatctgccatggccagcagatcctggctgccgctggggttcttcagggccggaagtgcacggcgtacccggcggtgaagctgaacgtggtgctgggcggggggacgtggctggagccggatccgatccaccggtgcttcaccgacggcaacctggtgacgggcgcggcatggccggcgcacccggagttcgtcgcccagctcatggccctgctcggcatcaaggtctccttcgcgtgatatcccggtcgccatggttcatcctcctcccatcacatgatgtacaaacacagatagacatactctact

SEQ ID NO: 7816 - DNA, 228 bp, Triticum aestivum
  Clone ID: LIB3281-056-P1-K1-E2
gattcggaattatgggaaggataccttggaatcggacgaacaagcacccatgactgagttatggccaaccctatcgatcagatacccgcgctgacggaaagaaacgaagttccattatagaggtgcgcgatcaaacagaacatcgagacctagtacggggcgctactgctgtcgacgacgttggtcaagatggaagccttgttggaggtggagttttaccacttatac

SEQ ID NO: 7817 - DNA, 396 bp, Triticum aestivum
  Clone ID: LIB3281-056-P1-K1-E3
cggacgcgtgggggaggccaaggccgacgtcgccgtcggcggcggggacggcctttcgaccatgcgcgagcagtgccggagcatggaggaggccatctccttccgccgtgaggcgcagctaggcctcgtcggctccctccagcaccttgtcccggacctggtcccctccctcgaccgttccctccgcctcatcgccgacttcaacgaccgccccttcacccctaccccaaatcccaacgccggcgacccccagaaccccagcctgaagccccaccaccgtcgcaccgtacccgacccggcccgttccacccgccgcaagacctctccggggtcctccccggcctgcgccgccgtgggaggcgctgcccccggaggtctcgacgcggtacgcaccat

SEQ ID NO: 7818 - DNA, 394 bp, Triticum aestivum
  Clone ID: LIB3281-056-P1-K1-E5
gccaaaccgaacgtattttattataacgcgctcgcacttaatcgtgagggctcagcagtcatggtcatcgccggtgacccctcatttgaagagctattgttcaagcatattccctctccacatggatccaaccacataatctactcacaacatcaaatgtagatcggagcatgttatatgcacagctactagcttatcacatgaatgcttaccacagtttttcacatatcttgacctatccactttaacgcggatttaatgctgtacttactggtcgaattttgattcactaacgtgagaatatctgttaagatgctgaggtatctgattgcactgtaccgatggttgactgttcaaggatcaacgagcttaataattcagagaagcctactgt

SEQ ID NO: 7819 - DNA, 285 bp, Triticum aestivum
  unsure (1)...(285): unsure at all n locations
  Clone ID: LIB3281-056-P1-K1-E6
aggccgggggggacccacgcgtccggcacaacggatcttaatttattggtgcacgcacccacaatattcggcggggtcaataaatatggtgacgatcanttgaacattcggtataagaactgttgtacaagaagatgcccacgcccgatgtatgcaccaagatctttactaacgaaaccacttttggatctgagattgttattgtttcagctactggtttggcaattaaaaacaaaacgcagcttttcagttctctgaacagttacactgcaaccctgatttaat

SEQ ID NO: 7820 - DNA, 343 bp, Triticum aestivum
  Clone ID: LIB3281-056-P1-K1-E7
ggacagtggatcttcatggaatggaggaggcaacacaaatgatggatcaggtggaggaaggtctgaagatcagtggaacagtagggattccgatggtggcagaggaaggggtagaggccgctttggtcgaggtgatcgcaatcaaggcaacaactttgggtcacgagacggggatggtgtcagtttgggctctggcaggggaaacagaagccgtggtggttgttacagaaacaatggaaatgacaacaatgagggaagggcctacagtcacgaccggggcgggggctggtctcacttttttgcttggaatgctgataaaaagggaagcacttaaggggatcaa

SEQ ID NO: 7821 - DNA, 359 bp, Triticum aestivum
  Clone ID: LIB3281-056-P1-K1-E8
gcatgttgctgctaagaggattgctgttggtaaatggggctgtagcaatggccaggcatgcattgctcccgattacatcataacgacaaaagctttcgttacagaactggtcgactctttgaaaagagtcttggaaaggttctatggggaggatccgttgcaatcggcggacctgtctcgtattgtgagtattagccatttcgaacgattagcgaagttgatagaggacaaggaagttgccaccaagattcagctcggtggtcagacagatcaggagcaactaaaaatagctcctacggtgttggtagatgttcctcttgatacagaacttatgacaggggaaatatttggccccatgc

SEQ ID NO: 7822 - DNA, 394 bp, Triticum aestivum
  Clone ID: LIB3281-056-P1-K1-E9
gttatgtatgggcaagatacccgacgtccatacgccgtcaccaggaaaattaagtgcattggagaaggcattaataattatttttgaaagaaagtcagagtttgtggtcaagagttcaattctttggctgaagcttacgacttctataacctagtcaaaattctgttctatttgctgggcaaagggtcacctggcaaatggttgtccctctcgaggagatgcacaaaaaaaccaaggatagaaccaaagtgtagcaagtgctgacctggagggcacaaaaggaatgcgtgcacacggagtatcttcagcgtgttccttcaaagcaaacccgagaatttattcgcgtcatagatattatctcgtctatattttggatgggtggtatcttatcatt

SEQ ID NO: 7823 - DNA, 398 bp, Triticum aestivum
  Clone ID: LIB3281-056-P1-K1-F1
ccttgaagcacattcgaacaacaaggacacaacatatggttgaccaattgacagaactccagagaagggaacaaatgttttcagaggcgaataaatgtcttcgaataaaattggaggagagcaaccaggttcatgggcagcagctctgggagcacaacaacaatgtactgagctatgaacgtcagccggaagtgcagccgccgatgcacggcggcaatggattcttccacccccttgatgcagctggtgaacccacacttcacatagggtaccctcctgagtccctgaatagctcatgcatgactactttcatgcccccatggttgccttgattgaagacggcgaagaaagtgtgaaaaataagtatatacgcggcacccagccggccgcatatatgc

SEQ ID NO: 7824 - DNA, 373 bp, Triticum aestivum
  Clone ID: LIB3281-056-P1-K1-F10
aggacctgcaaggatcactccaaccggcggtgctggggaatcggtttcggcctgcggttcagggtggtctcgcttgacctgagcttcagaaagcttgcaatggagcacattgttcaggcgtacaggaggtcgaagacgcgcgcgattctgctggactacgacggcacgctgatgccgcaggcgatcaacaagagccccactgccaaatcggtccagatactcaacagcttgtgccaggaccagaggaatgcggtgttcctttgcagcgggttcaaacgctgcacgctcgacgagtggttccctgccgagaaccttggcatggcagccgagcacggctacttcatgaggctgaagagggaccgcggatgggaga

SEQ ID NO: 7825 - DNA, 315 bp, Triticum aestivum
  Clone ID: LIB3281-056-P1-K1-F11
aggcaacaatcaaccaacacttaagtaagaactactgaatcccataacacggttgattagcagcggctgcagggttatacagctcatggtaagttcatacagacgagcagtacaagcattaagatcaggtgcttttgctttagcaatgttcaaaagagagagataactatactgggttgctggcctagacatttgcataggagagagaccacgaaaaaggttttgccaaaggtctaccttgcaagcgcaagaaacatccggtttgttaatactttcttcatcatcatcatcccacgagaatcaaagatgaaaagg

SEQ ID NO: 7826 - DNA, 390 bp, Triticum aestivum
  Clone ID: LIB3281-056-P1-K1-F2
gtgggctaaaattaagattcaattacccaattcagttacacaaatacataataagcttactacagcgcgatcgtcgtcaccgtttcctcacaacacacaccaaggggtgcaccggtgatccgctgcacccaaacccagatttcaaatttacagtctagcaccgtcgacacagccggacatcccgactaacagcacagaacagaaaaaactgctactggaaaactatcgccaagccctaggatcttcctccaaggatctacttcttggccttcttggcggcgggggccttcttcgccggcgcggccttcttggcgggcgcggccttcttcaccggcgtggatctcttggtgggcggcttcctggcggcgggcttcttgggcgccgcggcgg

SEQ ID NO: 7827 - DNA, 399 bp, Triticum aestivum
  Clone ID: LIB3281-056-P1-K1-F3
cccacgcgtccgcccacgcgtccgcccacgcgtccgatgtgaaggccaagatccaggacaaggagggcattcccccggaccagcagcgtctcatcttcgctggcaagcagcttgaggatggccgcacccttgcggattacaacatccagaaggagtccaccctccaccttgtcctccgccttcgtggaggcatgcaaatctttgtcaagaccctcactggcaagactatcaccttggaggtggagtcatctgacaccatcgacaacgtgaaggccaagatccaggacaaggagggcatccccccggaccagcagcgcctcatctttgctggtaagcagcttgaggatggccgcaccttggcagactacaacattcagaaggagtcaacccttcacttgg

SEQ ID NO: 7828 - DNA, 304 bp, Triticum aestivum
  Clone ID: LIB3281-056-P1-K1-F4
cccacgcgtccgcccacgcgtccgcccacgcgtccgcccacgcgtccgcggacgcgtggggggtaaataagtaccagtatgtttattgcatcaacgtgctaaactatacagcaaacagcccacactccgtacaagctggcgatactggcaacgccatccaaatacaataggcaacaacaacggaaatgtatgccaggatgcaagataccatatactcataaagtcataatataggacacagcagcgtctgcagaagctagaacgtaaacgaacgcaggcatcattcaaattaaaatagcaaagc

SEQ ID NO: 7829 - DNA, 404 bp, Triticum aestivum
  Clone ID: LIB3281-056-P1-K1-F5
cccacgcgtccgcccacgcgtccgcccacgcgtccgcccacgcgtccggggacgcgtggggggtaaataagtaccagtatgtttattgcatcaacgtgctaaactatacagcaaacagcccacactccgtacaagctggcgatactggcaacgccatccaaatacaataggcaacaacaacggaaatgtatgccaggatgcaagataccatatactcataaagtcataatataggacacagcagcgtctgcagaagctagaacgtaaacgaacgcaggcatcatccaaattcaaatagcaaagcactgaactgtatggtgcttacgaacgaacggcacagatccgggggcttcttcagccgctgcgggtccagacgacgtggtcctgcggcaggaagtggcaca

SEQ ID NO: 7830 - DNA, 400 bp, Triticum aestivum
  Clone ID: LIB3281-056-P1-K1-F6
cttctccttttcctctcccccatggttttgccaatctgggctctcttggcagagggattagctttgctggatctcatccattgtttcaggtatggcttgccctgtttgccgttgtctgggtgctccgtgcttaccagttgtggaagctcatgaagtcccagaggttttcgatgttgtagttgatgatgcttgcttcaggaggatgcagatctgctgttgttggtttggtggacgaaggagaaggtagttgccagcaagaatcgtctggagaagttagtcagaaacatcagaaggcaacaggagatctgagctttttttctcctttcatggtggcggctgtgtgggtgtcgagaaagaaagaagaggaggcaagagggaagacctagtgagctgtacgtta

SEQ ID NO: 7831 - DNA, 359 bp, Triticum aestivum
  Clone ID: LIB3281-056-P1-K1-F7
cggacgcgtgggtccgcacagaaaatgaagaagggctggaagcgacgggattgcctgcaacagcaggctcgccaggagcgtttggagtccaacaggagcaggctttgtgaaaatgacattgatgaaatggctgtgaacatgaccgaagatgatatggaaaacaggccagtgatgaaagacattgttgaagaaagttcagcacaggatttgaaagaaacaagttctatatctgaagacctatcttgcataatcgattatgactcaaatgggcttataaaagatagtggcatgatgcttcaagaccaatatgacgatggaaaaactggaataaatatgagaaggtggtatgacaacaattt

SEQ ID NO: 7832 - DNA, 376 bp, Triticum aestivum
  Clone ID: LIB3281-056-P1-K1-F8
acgcgcacgcgtacgcggacgcgtaggcggtcgcgttccatgccgagaatcataagacggcgggcttgcctgcggacgagcgaatcgtcatatgacatcgcaatccactgggggaaggacgcaccctagcgaataacaacatcctataagagtaacaccctacagcttgtccttcgtcttcgacgtggcatgcaaatgtttagcacaacgactcactggcaagactatcactttggaggtagcgacatatgacaccagacgacagcgtgaatgccactattcaagacaaggagggtattaacgcggaccagcagtgtagaaggttcgatggtaagcagcttgaggatggacgtaccttgtcagactacaacattca

SEQ ID NO: 7833 - DNA, 403 bp, Triticum aestivum
  Clone ID: LIB3281-056-P1-K1-F9
acgcccacgcgtacgcccacgcgtccgtccacgcgtccgatgtgaaggcggagatccaggacaaggagggcattcccccggaccagcagcgtctcatcttcgctggcaagcagcttgaggatggccgcacccttgcggattacaacatccagaaggagtccaccctccaccttgtcctccgccttcgtggaggcatgcaaatctttgtcaagaccctcactggcaagactatcaccttggaggtggagtcatctgacaccatcgacaacgtgaaggccaagatccacgacaaggagggcatccgcccggaccagcagcgcctcatctttgctggtaagcagcttgaggatggccgcaccttggcagactacaacattcagaaggagtcaacccttcacttggt

SEQ ID NO: 7834 - DNA, 404 bp, Triticum aestivum
  Clone ID: LIB3281-056-P1-K1-G1
atccgtcacaggctggacctcagctacaacaacctctgcgggccgctaccggggcggggctgtgtaatgcgggacggctgcaaggcctactagcacaacctttgccaccgcggggcgccgctcgagagcagctgccaccagctctgaactcgccgccggcgcccggcaggcgtacgttatatgagtggtgtgttggcgttctcgtgcgcatacggacgcacgaaggacggtgctttggggcttagtaaactcactagtggagtggagcaccgcggtggtggcaatgcctgacacgcgctgtccttgagcttgtgtacgaaacgatagagatgtgtgtgcgtgccgtgttcttgtgtgtgtaccgtctggagatgcgccccagagtgtgtgtgtgcccccgttat

SEQ ID NO: 7835 - DNA, 382 bp, Triticum aestivum
  Clone ID: LIB3281-056-P1-K1-G10
accgtgatggttttgttatgggagaaggggcaggcgtgctagtattggaagaacttgagcatgctaagcaaagaggtgcaacaatatatgctgaatttcttggtggaagcttcacatgcgatgcttaccatatgactgagccgcattctgaaggaacggggatcactctctgtattgagaaggcactggctgattcacgggtaacaagggaagaaattaactatgtgaatgcgcatgcaacatctacacaatcaggcgatttgaaggagtgtgaagcgatagttcgttgctttggccagaaccctcaggtatatattacctgatgccagaatgttttagcaacttcaggaatcacattcaataaattatacacatatccttt

SEQ ID NO: 7836 - DNA, 280 bp, Triticum aestivum
  Clone ID: LIB3281-056-P1-K1-G12
cggacgcgtgggctatatcttaagcaacccaacattatcgggctgatgattttaaatgtgcgggtcttacacctaaacttctaaatgcaatcccttaacgacctgatcactcctgctaacagtgatgctttcataaagcaaccccatttttaaatgaataccactgtttgccgtactagcagccaatgacttaaaagcagtctacaattcttctgttttacgcaaaacaatgggccgaccctatagaaatccccatctaaagattgtttacacatacaac

SEQ ID NO: 7837 - DNA, 399 bp, Triticum aestivum
  Clone ID: LIB3281-056-P1-K1-G2
agccctagcaagtctagcagatccagagccgaagatgagcggggtgaagaaggtgacggacgtcgcggccaaggccgggaaggcgatcgattgggacggcctggcgaagatgctcgtctccgacgaggcccgaaaggagtttgccaacctccgccgcaccttcgaggacgtcaaccaccagctccagaccaagttctcccaggaaccaaagccaattgactgggaatactacaaaaaaaggaattggatcgaaagttgtggatatgtacaaggaggcttatgatagcattgagatcccaaagtatgttgacactgtcactcctgagtataagccaaagtttgatgctctgttaatcgaaatgaaggaagcagagaagacatctctgaaggaatcagaga

SEQ ID NO: 7838 - DNA, 188 bp, Triticum aestivum
  Clone ID: LIB3281-056-P1-K1-G3
gtgtggttttttatttgtgggggcgggaaaaaattaatgccgattcggaaaaactacaccgaagaaattcggggtagacccctcggttagacgcttttcggaaaacccagcatgtacctcaacaactttatcctctttcactcgattttcaagcctagaaacggccgacattacgagagcaccacgcg

SEQ ID NO: 7839 - DNA, 291 bp, Triticum aestivum
  unsure (1)...(291): unsure at all n locations
  Clone ID: LIB3281-056-P1-K1-G4
ggaggcggcgccgtacacggtgctgttccacccggcgacggggctgtgcgtgctgcggcggtcgctgacgcaaccgctggagctgggcgcgtgcgccgacacggaggcctgggagtacgcgccgcagcaggggcggctggcactgcgggacagcccgctgatgtgcctccgcgcgcagggcgccggccggcccgtgcgcctnggcacgccgtgcgacgacgacatgtcccggtggcgcctcgtgtcggactccaagctgcacgtcgccgttaacacgtcgttttcgtcgtc

SEQ ID NO: 7840 - DNA, 289 bp, Triticum aestivum
  Clone ID: LIB3281-056-P1-K1-G5
cataccctcgccgtctactctgccacgaagcgcagctcgtcgagatggcgtcctaggcggcgaaggtgccgctgccggagtcggtgaacttcaagaggaagaggggagaggtctgggccgccgcgaagaagcagaaggtcgccgacgagaagaagaaggacgcggagaacaccaaggtcatctacgcccgcgccaaggagtacgccggggagtatgaagctcacgacaaggagctggtgcaacttaagcgtgaggcccggatgaagggtgggttctatgtcagttctga

SEQ ID NO: 7841 - DNA, 397 bp, Triticum aestivum
  unsure (1)...(397): unsure at all n locations
  Clone ID: LIB3281-056-P1-K1-G6
cggacgcgtgggggaggccaaggccgacgtcgccgccggcggcggcgacgacctctcgaccatgcgcgagcagtgccggagcatggaggaggccatctccttccgccgtgaggcgcanctaggcctagtcggctccctccagcacctcgtcccggacctggtcccctacctcgaccgttccctccgcctcatcgccgacttcaacgaccgccccttcacccctaccccaaatcccaacgccggcgacccccagaaccccagcctgaagccccaccaccgccgcaccgtccccgacccggcccgctccacccgcctgaagacctctccggggtcctccccggcctccgccgacgtgggaggcgctgcccccggaggtctcgacgcggtacgcaccatg

SEQ ID NO: 7842 - DNA, 332 bp, Triticum aestivum
  Clone ID: LIB3281-056-P1-K1-G7
gctggacctcagctacaacaacctctgcgggccgctccccaagctgcacggcgtcatgcggcacggctgcaaggcctacgagcacaacctctgccaccgcggggcgccgctcgagagcagctgccaccagctctgagctcgccgccggcgcccggcaggcgtacgttatatgagtggtgtgttggcgttctcgtgcgcatacggacgcacgaaggacggtgctttggggcttagtaaactcactagtggagtggagcaccgcggggggggcaatgcctgacacgcgcggtccttgagcttgtgtacgaaacgatagagatgtgtgtgcgtgc

SEQ ID NO: 7843 - DNA, 379 bp, Triticum aestivum
  Clone ID: LIB3281-056-P1-K1-G8
cggacgcgtgggcgaactctctggcgccgtgccggcgatcctcgccgacctgaagctgagctacctgaacctgtcgaataaccggctcgacgggcccgtgccgccggggctcgccatctcggcgtacggcgagagcttccaggggaaccccggcctctgcgccaacaacggcgccggctttctccgccgatgcacgcccggagacggtggacattcggggagcaccgcgcgcacgctcgtcacctgccttctcgccggcatggcggggctgctcgccggcctaggcgtggcgattttcatcaagaagcgcccgcaggacgtggaggccgcggccatggccggcgccggcaagctgctgttcgcgaagaaggggtcctgg

SEQ ID NO: 7844 - DNA, 389 bp, Triticum aestivum
  Clone ID: LIB3281-056-P1-K1-G9
tgcacactctaagcatttgatgcggtatggaagtgcaggcggtgtcaccagcaaagaatgaaacaggagcagcaggatagccatcatcaatcctggttcttggtgataacttgctaggcatcatacatggaagggcagtcagggaaaaccatgcagagtctaccggatacattgtcatccctcaaggggttcaacaagtacctcacacccagttggattgaatcagtgtcccacatcctcaaggagttgacaccaaccaaaccacagaaagtaatggaagaggaggctcaaaatgtatttgagtgtgatgacacacaattagacattaaaggtgcaaagattcaagatgaaatggtttcactgggtgcccaactaaagcagaaaacact

SEQ ID NO: 7845 - DNA, 313 bp, Triticum aestivum
  Clone ID: LIB3281-056-P1-K1-H1
gtttgaggaaacccgttcgtctcgtccgctcccgcgagcggcgaggcgaaccctagctcccgcctcctccagccccccgttccttccccccctcctcgccgccgccggctcgcgccgccgggcaaagcccggccagcgtcggcggcggcggggcttcttccccctcctcgcggcgggctggcgcggagcagatcctcgggtgggaggtggcccgttctgtaggacgacgtggcctcgtccttaacgaggagtcaccagccgaaccaccaaaggttatggaagagggcgctccaaacgtatttcagtgtgatga

SEQ ID NO: 7846 - DNA, 280 bp, Triticum aestivum
  Clone ID: LIB3281-056-P1-K1-H10
gtcatcatttaggtaggatgctgacagggatgggcgctcggaggggcgagacacggatggcacgtgccactgctttgctctcactctggggccgtttatgcacgagttctgagaccagggcttgtttacgaggtatacgctggctttctctatattgatgacaatggcgatgtcctagatattcctttgctatatgattggagatcattgtattgctcattcctaaagtgctacccgtgattctgagtgagctgactaaaatagatggtattttttttac

SEQ ID NO: 7847 - DNA, 354 bp, Triticum aestivum
  Clone ID: LIB3281-056-P1-K1-H11
cggacgcgtgggcagcaacccccctcacatcccaccgaaaccccatcttcccacacgctccaaccaccagcacccatggcacccaaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaagctc

SEQ ID NO: 7848 - DNA, 333 bp, Triticum aestivum
  unsure (1)...(333): unsure at all n locations
  Clone ID: LIB3281-056-P1-K1-H2
cggaccggaacggccggggcgacccacgccacccggcacgcgcaagcaagagaggaaagggacaanccccgagggacacgggggggggcccgaaaaccgagagacccaaaccgaacagacggccagggagacaacccacccnagggaccccaaggaaaggacaaggaagcccacgcacaagccaagnggaaagacaagggcaaaggacgggccgaacggaaagagacaagggagaagaagcacaggacccccaacaaacaagccaaaagcccacaaggcgagaangacaggacgccgaaaagagacgaggagcaaaaaaacacaaagaacaaa

SEQ ID NO: 7849 - DNA, 396 bp, Triticum aestivum
  Clone ID: LIB3281-056-P1-K1-H3
cccacgcgtccggcccaatggagtttaaaaaaaactgaacagtcctcagacttagccaattttcaggaattccatagtattgtgagtaaaatgcaagcgcggtcctaattctttcccaaaagtgtcgactgggtcctaattctttcaaaatgcacatctgggtcctaaatctttctaagttgttcacccgaggtcctaatttcgactgtccgccgctgaccagctcgcgtggcgctttgaccgctgccacgtcgactcgagggcccacgagggataacgaccagccgtgcattttttcaaaagagccccccaaccctaatctctccacagccgtagtcctttcctctcctcttccccacctctctctgctctggcgaaacaggggagatcgacggc

SEQ ID NO: 7850 - DNA, 403 bp, Triticum aestivum
  Clone ID: LIB3281-056-P1-K1-H4
gaccagcttaccacagagctagactggacagaaggcaaggagatcctactcatgagtggaaatgtgcgtgttaaacagcgcgaagccttgatggaagccttcaacgacatgaacagtgaggctaaggtgatgcttgcatcaaccaaggcctgctgtgaaggaataacactggtcggtgcatcgcgtgtggttctccttgatgtcgtctggaatccttctgttggacggcaggcgattggccgagcctatagaatcggccaggagaagattgtgtacacatacaacctgattgcagaaggaacaaaggagaaggtcaaatatgacagacaagctaccaaggatcacatgtccaaattactgttttcaaatgaaccgcaacctactgggagcaatctgtcaccgg

SEQ ID NO: 7851 - DNA, 362 bp, Triticum aestivum
  Clone ID: LIB3281-056-P1-K1-H5
gaccagcttaccacagagctagactggacagaaggcaaggagatcctactgatgagtggaaatgtgcgtgttaaacagcgcgaagccttgatggaagccttcaacgacatgaacagtgaggctaaggtgatgcttgcatcaaccaaggcctgctgtgaaggaataacactggtcggtgcatcgcgtgtggttctccttgatgtcgtctggaatccttctgttggacggcaggcgattggccgagcctatagaatcggccaggagaagattgtgtacacatacaacctgattgcagaaggaacaaaggagaaggtcaaatatgacagacaagctaccaaggatcacatgtccaaattactggt

SEQ ID NO: 7852 - DNA, 310 bp, Triticum aestivum
  Clone ID: LIB3281-056-P1-K1-H6
cggacgcgtgggcaggaacccgcctcacatgacaacccaaccggggataacgaggagcacgtggatggccagaagaaggagaccctcttctccaagctgcaccgatccagctccagctccagctcgtctagtgacgaggaagaggaggaggtgatcgacgacaacggcgaggtgatcaagaggaagaagaagaagggtctcaaggagaagctccaggagaagctgcccggccacaaggacaccgagggtgagcacgtgacgggcctacccgcaccggcggcccccgtgttcgtgcagactcaccatgaca

SEQ ID NO: 7853 - DNA, 300 bp, Triticum aestivum
  Clone ID: LIB3281-056-P1-K1-H7
tcgcccacgcgtccgcccacgcgtccgcccacgcgtccggtcagattccaccaaagcatatatcccttgtccattcaactgtttctttgaatatagaggaaagcaaatatacaattgaaactataaggagcggacagggtagctacagattgcgaatgaatggatcagttattgaagcaaatgtccaaacattatgtgatggtggacttttaatgcaggtggatggaaacagccatgtaatttatgctgaaaaaaaaggcggggggaccacggtttttaatggagggaaggccttcttgg

SEQ ID NO: 7854 - DNA, 392 bp, Triticum aestivum
  Clone ID: LIB3281-056-P1-K1-H8
ggacatgcaagaagttaaaggtatatttcttgaggggcactgtggtttgccggagaacttagataccgaagtcgatcagcttgcctgggagcattccagtttgctacttcaaggattggactatgaatcctattcagaagctaagttgatagatatggtcaaaggactgtccgaacgtatagagactatggagaagaagcagattatttccaacaaagaagtcaaatgcctacaaggagtgaatgacaggttgctgaaaagagttgttgagctaaagaacacagtgaagaatttgaattccaaaatagatcctttatctctagatgattcactaaatcagtttgttgaagaatgtttgggttcagaagatgtcatttatctcattgggggtt

SEQ ID NO: 7855 - DNA, 382 bp, Triticum aestivum
  Clone ID: LIB3281-056-P1-K1-H9
gcagcaactaagggaggagcatgtcggcgatatgggctagcggcaggaagacacggctggcaggtgcagttgatatgctgccacctgggccccttcatgcacgacttacaagaccagggcctttttccgagggatgcgctgggtttctctttattggtggtgtatgagatgtcctaaatattcctttgctatatgatttgagatcattgtattgctcattcctaaagtgctacggataatctgattgagctgactaaaatagatgttcttttctttacttggcatctgcttgtgttcattgttctacaatccttgctttacagtgtgcacgctggtatgttctggtgccaggctcaaatcggtgagacccatgccaatacat

SEQ ID NO: 7856 - DNA, 292 bp, Triticum aestivum
  Clone ID: LIB3281-060-P1-K1-A7
aacttgaacaccctttgcggttctgctgatattctcccggggatttgatccttcagaccttcactcctcgtgctcgctacacgagagcaagtttttggttggcaagggaaataagctgcaggaagctctatactatacgctttacttgatctcgacctccgtggatatgcctatgaatgcaaaatcagcagaaatgctggtatgcttttcgatcaatcgagggagctaatatgctgttgtatagtttcctaaaatatgagcgatgtattctagtaataaaataaatgcctga

SEQ ID NO: 7857 - DNA, 255 bp, Triticum aestivum
  unsure (1)...(255): unsure at all n locations
  Clone ID: LIB3281-060-P1-K1-A8
cattctactttggtgctcgatggggatttgataaaagtgacaggaaacncctgtttggtatgattaatgagcttcccacaatttttgatgttgttagtgggaagagtaaaaccaaggctcctaccaacaataaccacagcaatagcaaatccaagtccaacaataaaatgaaaacctcggagcctcgggcgaagcaacccaagccccagctgaaggaggaagatcacgaggacgaaacccctttttcgggctaag

SEQ ID NO: 7858 - DNA, 253 bp, Triticum aestivum
  Clone ID: LIB3281-060-P1-K1-B3
atgctaagttcaaactctgcgatgtcatgtctttccagtttggccaaaaaggcatcccatacctcaacacctatgatggccgcaccatccgctacccaaacccactcatcaaagccaatgacaccatctatcttgacctggagaccaacaaaattgttgacttcatcaaatttgacgtctgcaacgttgtcattgtgactggtgggcgcaacacttggcgtttttgtttgatcaaaaacaaggagaagcataa

SEQ ID NO: 7859 - DNA, 325 bp, Triticum aestivum
  Clone ID: LIB3281-060-P1-K1-B6
ggtcagcgcccatcttaaccactctagtctacactttttaaagtcccgggagacgcttgaactgatggaggagttggccgaaccagcaggactcaacaacacaatttgcatctccgcggtattcaatttggagaaaggtgttttaatgaactactcaataggggtttgatccaacctgggaaaatagatgtatatgacaacgtgaagaggtgtcgagttcatgatacaattcttgatttcatcatatccaagtctataaaaaagaactttgttactatacctggggttcctattctgacaattgggaaccaaaacaaaggtggtc

SEQ ID NO: 7860 - DNA, 285 bp, Triticum aestivum
  unsure (1)...(285): unsure at all n locations
  Clone ID: LIB3281-060-P1-K1-B8
tctctcaaccctcaagataccctccaaatacatagagtaaacttcactcnannantnanttnacctcatttgatctaactaaccatctattaagtttgtaccatgcaccactactttactttctcttcaactctcacacaaatccataactatctccctactctccatactcatcaccaccctaacctactacttcctcatactactctcccaatactacaacgtctaacataactacaccttcattttcatcttcagcgactccctgaccgacaaccacaacct

SEQ ID NO: 7861 - DNA, 363 bp, Triticum aestivum
  unsure (1)...(363): unsure at all n locations
  Clone ID: LIB3281-060-P1-K1-B9
gcgtgggctctcctttctttccnnctccncgtcttctctccggcctntgcttcccctgccctgtggctctccctttcntctgcncgcctcctgcttctcgtgcccgtcgcctttgccggggtttcctctgnggntgngccgctgcttctggttgtgctcttctnngggccttgtcctgttgcttgtcctctcgctgcctgcnngnggggtctcctccttctgggcgttggctgtcgtggtgtcgtccccgtgctcntgcctgtcgtcggngtccgtgcctggcctgctgtggtccctctgccctgtggcgtcgtccctggtgctcgccgcctgccctcgctgcttcttcttcgtcctgctccc

SEQ ID NO: 7862 - DNA, 401 bp, Triticum aestivum
  unsure (1)...(401): unsure at all n locations
  Clone ID: LIB3281-060-P1-K1-C10
gacagatgggcacaaatctctatggtgcagcacctacaaagcactggaagtctnaaacagcagcagcaacaacgacaagtcgaacgaattacaagactgactgaagaaaatgacggttttttgtactcgacgaagaaccctagaaaaggaacccagaggtagcagcatccgagaggccgacacgaagaggaagtcaatacccgaaccaaccgcccttgcatagtggtgaccgcatcttgttttcgcaaatgtttttttgcatgaaacgaagaaagtcacggagtttccccggttgaattcacggggaacaatctgtggctatgagcaccacatggcaaggagagtctgaggtgcgttcttgacttcccactaatgaaggctccaaaattttgccgctcctc

SEQ ID NO: 7863 - DNA, 437 bp, Triticum aestivum
  Clone ID: LIB3281-060-P1-K1-C11
cccacgcgtccgattcactccagccccttgccactcgcactcgaaaacctctctcttcctgcctgcaagagtctccaggaagagaaagagagggagagatcgatcttgcgtcgccaagatgttcatcgagagcttccgcgtggagagcccgaacgtgaggtacggctctgtggagatcgagtccgagtaccgctacgacaccacggagctggtgcacgagagccacgacggcgcctccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggcgacaaaggacaaggtgcagcaagccaactactttgggtccctcaccc

SEQ ID NO: 7864 - DNA, 444 bp, Triticum aestivum
  unsure (1)...(444): unsure at all n locations
  Clone ID: LIB3281-060-P1-K1-C6
cgaacagntgtcacttcagcaagacccgaatggccgtttttctctagaaaaaggactcattcgttgtgatcgtataatttggctgggaggaggcatgcagatacgacaacgcatcatttgtactttccacgacatcctgatggaggggcactccgaatttccagtgacttatcatcgcatccggcgtttgtttgcgtggccaaagatgaagacgcacatcctccaatacgtgcgctgctgtcagatatgtcagcaggccaaaccagactgngctgcttctccgggtctactccagccactgcgtgtgcccagtcagccgtgggagatgatctctatggatttcgccgacggcctatctcagtccagcaaattcaattgccttctggtcatcgtcgacaagcgtaccaagtttgcctattttctgcctcttgctcacccttacac

SEQ ID NO: 7865 - DNA, 427 bp, Triticum aestivum
  Clone ID: LIB3281-060-P1-K1-C7
gggcgtacattgtcatcatcaacaaccttagctggtcacctttatatactcggagttattcggacccatgtatgccttgcaagatcaacattcttactctcaacatagaggacatctgccatttttttattgcactaacgtatttttgctgaagcataaatttcgagacctttgcaagcctccttgacatgggcctctttttccgcttcgacataaatataattttttagatgatctaacgcaacaacagactttatctggagatctgtcctatcaatgaacttttgcattagacagattgctgtctccctctcatgcccaatcgcacatttcaccatccaaagctttggatctttcacagatggcaagagagcttgctgttcaacgtctgcagcttcctctccatactcaatatgagtagatcttg

SEQ ID NO: 7866 - DNA, 442 bp, Triticum aestivum
  Clone ID: LIB3281-060-P1-K1-C8
tcgatttaaacctcaccaggttttcttgtttttaaagcatgaaagcaaggttgaagcgcttatttgtggtgccaggttctgcgaggcaattcaaaattgttctagattttcttggattggtagagaaattttactacctttctggaacatatgaccttgagctttctgttggtgatgcttcaatggaaaattcgttcctacgtgcccttggccaactggagttggacttgccggaggcccctgaaaaggccccacgtcctccggcacaagctgttgacccgttagcaaagtttaggccacaaaaggagatagagcacatattccgtgtgccagagaagaggccactgcaggaagtatcgcttgcatttactggcctcacactcctgcctttcattgggttcttgattgggcttatgcgtctgggagtcaacttgaagaactt

SEQ ID NO: 7867 - DNA, 435 bp, Triticum aestivum
  unsure (1)...(435): unsure at all n locations
  Clone ID: LIB3281-060-P1-K1-C9
cgctcctcctcccgacccaggtgctccgcctacctagggcatccgcatcctgcgctctagcccccgcgatcgggacaccccccgccggctagcgatgttgccccctccgcgccgcggcccggcgtacaagaccaagatgtgcgcgttgtggcagaacggcaactgcgaccgcgagctctgcagcttcgcccacggcacggccgagctccgccggcccccctcctcccggcccaccttcccgccccaccacgccgaattaggtggcattcttactggttgtcttttgatttaattgccatcacaaatttgttagactcgactgctgccagaggataacatggccttttccatagatttcttcgattggtattttgatgatttgtcgngaccactaaatgctcgggctgtatcagaaggtgaacctttgagggtatt

SEQ ID NO: 7868 - DNA, 237 bp, Triticum aestivum
  Clone ID: LIB3281-060-P1-K1-D10
tccacccagcgtctgctcgcacgccaccttcccctacgctcgcgcctcgacgccggtccctcgcagcggccgcctctccccgcgcctcggatcgctgcaggcgggaaattgtgggtgcctgatgacgtgattgacgcacacatgccgcgctaggtaaatgacgaagcttggcctggagaaggggtggcaacatccgggcattccaaatcctaacgttcggtcattcgttccgtggtg

SEQ ID NO: 7869 - DNA, 144 bp, Triticum aestivum
  Clone ID: LIB3281-060-P1-K1-D11
cgatgaggaaggccgatattgtatctgtgatttctgtgggaatggcgaaagatgcaaagctttcaatcttaattctcctgtgaacctgaatcttgtgagtctttgtcacctgcctttgcatctaaaacatttggtttgcatctg

SEQ ID NO: 7870 - DNA, 377 bp, Triticum aestivum
  unsure (1)...(377): unsure at all n locations
  Clone ID: LIB3281-060-P1-K1-D12
ccgagccgtcaaaatccaatctttgacggagttttcctcgccctcccctactgttctaggctcncttttgaattgttaggggctcctcaataattattattggcaggcagccccgggttggtgattactgctaatcaggctgccgctgcctaatccacgaatcctttcgtgattctcatcccagtatagtcggcttctttctttctttctttctttctttcttggaggttccttggattcatccgttcatcgggcgggcgtgcgggctcgatcagaatgggcggagactgctgcttctgggtagggctcgcatccaatttcccaccaccacaactagtacgcttgttttttattgttccaagagtgagatttgcctt

SEQ ID NO: 7871 - DNA, 440 bp, Triticum aestivum
  Clone ID: LIB3281-060-P1-K1-D2
ctcattattgttgataataagacatcaaacatcatcgaggaaacaaagaagatacaaatgagaagaaagcctaacagttccagtttgcatatgcagaatcctgctgcagatgcattcccccctccgagtttcactcagaataaagctgaggcagctcaagagacccagttaaaagcttctcgcgacgtaaggttgctaatgcgatggctgctaaagcaaaacttgtacttcgtgaactaaaaaccgttaaagcggacctagcctttgcgaagcagcgctgcactcagctagaagaagagaacaaaatgttgcgtgaaactaagcagaaaggggtcaaaattgaagaggatgatgacctgatccgcatgcaactggagacattactcgccgagaaatcaaagctggcacaggagaactccatgtatgcccgtgaaaatcgc

SEQ ID NO: 7872 - DNA, 456 bp, Triticum aestivum
  unsure (1)...(456): unsure at all n locations
  Clone ID: LIB3281-060-P1-K1-D3
gggggcacgcgtccgcccacgcttccnaacgcggtgtacatggcgatcctggttgagtacgataacgtctacgagaacgtgtttcatgtggacctgatgnattcntncctccggggacgcgtcgggcggtggacgcggatgcgcgagtcgtggggctccatctggcgcctcgactccaaccaccgtctccaggcgcccttctccctccgcatccgcaacgagtccggcaagaccctcgtcgcccgcaacgtcatccccaagaactggaggcccaacaccttctaccgctccatcgtccagtacagctagacctcttcctccgtcgacgggtcgcggcacagctctgttttggcgggagttgatgctgttttggcgggagttttcaattaatttctgaatgaatgaacgaacgaatgaattgtgtactacctatcgtgggaaatagaggaggcaccc

SEQ ID NO: 7873 - DNA, 466 bp, Triticum aestivum
  unsure (1)...(466): unsure at all n locations
  Clone ID: LIB3281-060-P1-K1-D4
ccgaatttgggaacgacccacgcgtncgcgcgcgtggggtccccaaatccctaaccctaacccgaataggcggcggctgagaggggaaagcggagggaagatggcggcggctgctgaagggaaagcggaggggaagatggcggaggctgaggaggggaaagcggaggggaagatggcggcggctgcggaggggaaagcggaggggccctcctatcctgaccgctcgacccccccgatccttgaggtcgccctcggcaaggatttcgtcgacattccctccaacgccgacgagagccccgcctggctgctactcgtcggcgtcatgagcggcggcctacgcttccaccgttttggcgtggcgagatctgggcggatctccggtcggagcgacgacacgctccagatcttccacgacctcaagaagcgacagggttgcagccggagcgcccgcgcagccatggcatct

SEQ ID NO: 7874 - DNA, 456 bp, Triticum aestivum
  Clone ID: LIB3281-060-P1-K1-D5
accaggcgtccgcccacgcgtccgtcctcatacagagggatgatgtgtacttcgagaacttcgtcaacatgctggacggcgtcttctccttcgtactgtacgacacccgcaacaagacgtacatggccgcccgcgacgccgtcggcgtcaaccccctctacttcggccggggcagcgacggctccgtctggattgcgtctgagatgaaggcgctccacgaggactgcccaaagttcgagctcttccctccggggagcctctactcgagcgccgccggcgggttccggcggtggtacaacccgcagtggttcgacgagcacgtcccggcgacggcataccagcccctcgtcctcagggaggcattcgagaaggccgtcatcaagaggctcatgactgacgtgcccttcggcgttctcctctccggcggcctcgactcctccctcgtcgcctcggtca

SEQ ID NO: 7875 - DNA, 427 bp, Triticum aestivum
  unsure (1)...(427): unsure at all n locations
  Clone ID: LIB3281-060-P1-K1-D6
gcctnctgccctccccatctgcttaggttaggttaggctatgggcttcgcagagctcgcggaaatgatggccttcaggtggcatcagtaccaantggtgggtcgcgcgctgccgacgcccggcgatgagcagcctaagatctaccgcatgaagctctgggccaccaatgatgtgcgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcaaaaccggctaccacaacatgtacaaggagtaccgtgacaccacactgaatggtgccgtggagcagatgtacactgagatggcctctcgccaccgtgtgagatccccct

SEQ ID NO: 7876 - DNA, 425 bp, Triticum aestivum
  Clone ID: LIB3281-060-P1-K1-D7
cttatggagctcgccacattcgccggcccccagttctcaacagaggcttgtgcggtagagttgctctgcggtacagaatgcgacattgttgacatgttacaatcatcgctaaagatgattaaaaagaaccacttccatgaagctgccaaggccgctggacaccctctaccgcttcagctgggtgaactgcaccggctgctggtggtgttccccgagcagcgaagcgtgctgctctcctttatgaccaaggctcgaactgacggtaccgtgttgcgcctcgatgacatgacacttcatattaggcgcatgtggagcagatactcgaaggttcgtgtcggctgctatgagcaagctcctgatctttttccagagtctcggaggttggtgtctagcatgagatcacagtatgaggaggggatgagctg

SEQ ID NO: 7877 - DNA, 435 bp, Triticum aestivum
  Clone ID: LIB3281-060-P1-K1-D8
cggacgcgtggtcggacgcgtggactcctccttctcttggattggaacactggatctgctccaagatcgatcctgaaccaacccaagataagcaatggctctagttggtcaggctgccatggttgcgcagtttgcaggagtggacgcctacgggctcatcaagatgatcgccgatgcggcgcagacggtccggaggaacagagccacctgcctgcagctcgcgcgccgcgccaagatgatcggggacctgctgcaccagctccacgccgcgcagctcatgcagcagccggagacgaggaacccgatggagcagctcgaggagacactccggcgcgcgctgctgctcgtcaggtcctgccagggccgtggatacctctaccggtgcttcatgggggcgcggcacgccgacgagctccgcgaggtgcagggtgagat

SEQ ID NO: 7878 - DNA, 434 bp, Triticum aestivum
  Clone ID: LIB3281-060-P1-K1-D9
cagtttagcaggttcatcgatgaagcttgccatcaaattgagcgtaatgaaaggaatgtgcgtcaaacgggaatggtagcctacatcccaagatttgctgtccttgcatcacggatggagcaatatattcaagggcaatctagagatttgattgataaagcatacacaaagctcgttagcacaatgttcacaactttggagaaaattgcacaaagtgatcctaaaactgcggatattgtactgatcgagaattatgctgctttccagaacagtctttatgacttggctaatgttgtgccaactcttgcaaagttctaccaccaggctagcgaatcctatgaacaagcttgcactcgtcatatcagctcactcatttatcttcaattcgagaggctgtttcagttttctcgaaaagtcgatgaattgacatacac

SEQ ID NO: 7879 - DNA, 75 bp, Triticum aestivum
  Clone ID: LIB3281-060-P1-K1-E10
cggacgcgtgggtgttatggtactatgtattggcgcgcgtgttgcagtaatcccaccatggttcagttatctgtg

SEQ ID NO: 7880 - DNA, 442 bp, Triticum aestivum
  Clone ID: LIB3281-060-P1-K1-E11
cccacgcgtccgctcacatcccatctctccacacgctcgaaccaccagcagcagcagcacccatggcacccaaggcggcggagaataatcccgcggagaagacgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcccgctacaacaagaagcccaccatcacgttccgggagatccagaccttcgttcgcctcgtcctccccggtgagctcgccaagcacgc

SEQ ID NO: 7881 - DNA, 439 bp, Triticum aestivum
  Clone ID: LIB3281-060-P1-K1-E12
ccaacgcctcctactcgtccctcaccgtcgagcagtctttccagaggctcaacctcaccgagtcgctcgccggcatcagggccaacaaccccgccgtcgtcgacctcaagctcatcgacgcgttcaaggccgtggtgagcagcctcggcgagaacaacgtcatggtgatcctggacaaccacgtgagcaagccggggtggtgctgcgacaacacggacggcaacggcttcttcggcgacggctacttcgagccggacgtctgggtcgacggcctcaccaagatggccaccatgttcgccggcgtcccccacgtcgtcggcatgagcctcaggaacgagctccgaggtcccaggcagaactcaaacgactggtacaagtacatgcagcggggcgcggaggccgtgcacgcggcgaacccgcgggtgctggtgatcctctc

SEQ ID NO: 7882 - DNA, 441 bp, Triticum aestivum
  unsure (1)...(441): unsure at all n locations
  Clone ID: LIB3281-060-P1-K1-E2
caaccacccgggcctccgtgatgttcccacaccaaactattcggtttgcaacagcgtcatctatcccaacaaggctgccgcgtctgtcctcaaggaggatgcgttggctcgggttttgatggacccaactcatccaacggagatactcactaactacgaggcgtggaccattgatctggggaagctggacatgggggctccttttgctcagggggcctttgggaagctgtatcggggaacgtataatggggaagatgttgccattaagctgctggagaagcctgagaatgatctagagagagcacagttgatggaacagcagtttgtgcaagaagttatgatgctttccacgttgaggcacccaaatatagtaaggttcatcggggcatgcangaagtcgattgtttggtgtatcattactgaatatgcaaaaggtggctc

SEQ ID NO: 7883 - DNA, 435 bp, Triticum aestivum
  unsure (1)...(435): unsure at all n locations
  Clone ID: LIB3281-060-P1-K1-E3
gttgggatgctactcccaattgggaagacattttgtccttgggagaacagcanaggctaggcatggcccgcctgttctttcactctcctaagtttggcatccttgacgagtgcaccaatgctacgagtgtcgatgtcgaggagcatttgtacaggctagcaactgacatgggtataactgtggtcacttcctcccaaaggcctgctctcatacccttccattcgttggaactgaaactcatcgacggcgaagggaagtgggagctgtgttcaatcaaccactagtcactgcctgtcgccctaatttttgaccggctttagctactctcagctgtatactgacttacagtacaaatagtcattagctgctgcttcaacaaacagaggctgcctgtagaagccagggaggcatgcagcacccaattggagatagatc

SEQ ID NO: 7884 - DNA, 199 bp, Triticum aestivum
  Clone ID: LIB3281-060-P1-K1-E4
gcgcccacgcgttcgcggacgcgtgggctatagactattgtggttaagaatacagattcattatcttaggtagtgagcccataatggatggataattgccaccaccaagctttagggaaagcatgtaaccttaaaaagagtaaaccaagtaaagtagaacctccgtttattattttacagggaagagatttttattaag

SEQ ID NO: 7885 - DNA, 442 bp, Triticum aestivum
  Clone ID: LIB3281-060-P1-K1-E5
gttttgaaatgccttactaaagctcctagagtgccagctatagactggggggttatagtacggcggtgcatgaaagttgaggcacaaattcctcagaagtcaaccaatcatcgagatcctacattattaagggaagaatgcttatatttttctctagctcatgccgatcatatcagtccccttctacagtttttggatgatctgacagatttacccaggttcaggagattagaaatgaacgtgcagtctgttttgctccaatatttgtcacacctaatgaagctcttctctgattcaagatctaagaaactgtacgaggatttagctgtgtacttctgttcccacttatcttcacacttggattactcttctgagcagagaagcatgttaagaatgtccttctggaaaggcatctgtaagtgcctgatggaggtggtctctg

SEQ ID NO: 7886 - DNA, 449 bp, Triticum aestivum
  Clone ID: LIB3281-060-P1-K1-E6
atcggccattgagaggaagcgaagagagagcggcggaggaggcgaaggcatcatccatggccgcggtggtccggagcgtgtggcaggggatcagggagaagggcctcaccaacttcctccgctacgcccgcgaagagggatacctaaaatgccttggggacggaaacctattgcaaaccaaaattcacaacattggtgcaacccttgtaggagttgacacttttggaaacaagtactatgagaaactacatgacactcagtatggaaggcataggtgggtagagtatgcggacaagggtcgctacaatgcatcccaagtgcctgctgaatggcatggatggctgcaccacattacagacagcactggggataagctgctggaggagaagactaaaaagttcattagggagcacagacagaactacaccggacagggtgatgacttgatc

SEQ ID NO: 7887 - DNA, 436 bp, Triticum aestivum
  Clone ID: LIB3281-060-P1-K1-E7
cccacgcgtccgcccacgcgtccgaaaagagagggttgccgaaaaatcttgggggtggaagctgcgaaattctcgaaacagccgggcagggggcgcttggaacattatataaagttctagaatctgccattgcagatagagagaacgggtcatcagctcaggggcaaataatttgggtccactttggggtaaatagtggtgcatcacggtttgctcttgagaatcaagctgtgaatgaagccaccttccgctgcccagatgagcttgggtggaaacctcagagagtgcctattgtgccatctgatggaagcatctcacggacaagagagactacactgccagtgaaggagttaaccaagtcactccgaaagacaggctacgatgtgatgccttcggatgacgcggggagattcgtgtgcaactatgtgtactacca

SEQ ID NO: 7888 - DNA, 404 bp, Triticum aestivum
  unsure (1)...(404): unsure at all n locations
  Clone ID: LIB3281-060-P1-K1-E9
agaagncncacaagaagggacacatttatgggctctaccataatccttgcaagagccctgacaataactcgtagagccactgctaatactatcggcattactagctgcagcaaactctcctacttactggcggagtacctcgcgcgtacggtcccacccctgatgatcgtcacggtgatcgtcacgttctaagaaccggacgtcataaacgacgtgatgatcgcattgctaatcgtataccggatcctctacacagacttagtttaaccctcagagcacctattcgggcacgtagtataataggcagcgcgttacgcggctctacccttcttcatagagttcctcgagaagaccatcgtgtcgtccactcagtgacacacgcatcgcctgctgaatctcgtgat

SEQ ID NO: 7889 - DNA, 307 bp, Triticum aestivum
  unsure (1)...(307): unsure at all n locations
  Clone ID: LIB3281-060-P1-K1-F1
cgcgtncgcccacgcgttccgccacgcgttcggctggctgtattggcatcaccaattcaagctgggaggacggaagctggaataggaggagacgattgttcgtccattaggcatgaacgcaactccactgtactcccttttttttcgtaaccaattctttggagcagacatgtgggtacagttacatagcgtcaagattgtttgctttttttggttagtttagatttagatttctcagatattcactatttgatcaatcgatccatgtagatctcattgacatggtttatggaatgtacctttcagc

SEQ ID NO: 7890 - DNA, 441 bp, Triticum aestivum
  Clone ID: LIB3281-060-P1-K1-F10
cggacgcgtgggcggacgcgtggggcgaagattggaatctccgtggcaaaggccatccgcgccggggccctcaagctcacactagggggtgtggtgcttggggatagctggatctcaccagatgattttgcgctgtcatatgcgcaactgttgcatgatgtatcgaggctgagcgacgaagctgttgcccctctcaacagaatggcggcaattgtaaaagagcagatagcagccggacaattcaccacggcgaagatgacgtggacgaatcttgttgatttgattgaccagcagagtgatggcgtggatatgctaaatttcttgcttgacaaaggcgaaggctcatcgacgagccaggtgtttccgtcgacccccaacaccattgacggtctcatgaatggggtcattaaagaaatagtgaaggttattcctaagaacata

SEQ ID NO: 7891 - DNA, 213 bp, Triticum aestivum
  Clone ID: LIB3281-060-P1-K1-F12
cccacgtgtccggccgccgcaccctcttctcacacgcctcagcgccctcccctgctccgtgtgccgccggccccattccttctccccgcgctagaacagagatgcgcctcagtagggcagcagcagcagtagcgtctccatggacgcgggggattgacggttccaaggaccggatcccttctttggcttcaatcttcaacttttcgggtggcc

SEQ ID NO: 7892 - DNA, 444 bp, Triticum aestivum
  Clone ID: LIB3281-060-P1-K1-F2
gccatgcgtaaaccaagctgctgagagtctaccccagccacaagggggagctgctccagtggttcaggataccccacccagccccacaagggttgacggaccccccaaaaaagaactctctctaatcgaatcggtgactccacgacgccccccgctcggcgctcgctgctctctccccctttccctctgtctcggcgccgtcgcggccatcgatcgacctcgaaggaggcgcggcctgcagcctccaccttcgctcagtcaagtttctaaaacaatcacatgtccaaggcacgcaacgccttagttgtcactggcttggtaatatttgctggctctggcctagcatttcccttctactttgtgaaatcaaagaacaggcctattatcgactcaacgaagcctctgccaccgcaggctactttccgaggaccatatgtgaacact

SEQ ID NO: 7893 - DNA, 440 bp, Triticum aestivum
  Clone ID: LIB3281-060-P1-K1-F3
cgcacagcatgctgtcattcagatcgagcagcgtcaggaagaagaagaaacagctccattggtgtcagcagcatcggccaaccctactgtcgccaatgaggagcatacacaaatttcttcatcaaaacctcccgaggaggagtttgagatgtttgagtctagcaggggcatcaagctggggcttggcgattttgtcttctacagtgtgcttgtggggagggctgccatgtatgatctcatgacggtgtatgcgtgctaccttgccatcatcgctgggcttggctgcaccctcatcctgctgtcgatatgcaggcacgcattgcccgcactcccgatctccatcatgctgggagtcgtgttctacttcttgacgcggttgctgatggagccattcgttgtcggtgcttcgaccaatttggtgatgttctgagttctgacta

SEQ ID NO: 7894 - DNA, 446 bp, Triticum aestivum
  Clone ID: LIB3281-060-P1-K1-F6
acggttaacagtgatgatctaatcttagaagctttcaagtgcatgaaggataacaaaattggcggcgtacctgtagtagaaggtcccaaaaggaaactggtcggtagtgtgagcataagggacattcgcttcctgttgcttaggcctgacttattttctgatttcaggcatcttaccgtcttggagttcatgaatgctctaggttccactcttcctgattcagggggcaacggactggtgaagccgccgctcacctgtgcacctgatgcctctatgggcagcgtgatcgacagcatcggatcgaggataacccaccggatatacgtggtggatggtgactttgaggtggttggtgttgtgacactgcgagacgtgatctcttgcttcatccacgagccccctggcttctgcgacagttatcttgcttcagcgatggagaagctcga

SEQ ID NO: 7895 - DNA, 438 bp, Triticum aestivum
  Clone ID: LIB3281-060-P1-K1-F7
aatctgctcaaaattgtatgaatcatcatatgttgactctcacgacatatcatggtgggaggacacctcatgtgcgcaacaccacattcaactatataaatcagttcaaataggcacaaatgatcgacattcggtaaaaagaacaatggttacagcaagttgtgacccgaggaaaatccacatggtttggactctggagagtccacaccgtctcaatggcaagttgatcaaaaagatgtgctcgtattacttgctatttgctgacgccggcttcaaccatgggtagacgtccggtgatgagggcagccttgctgtcaaaacttcaactccggtttccgtcaccaaaagggtgtgctcaaattgagcactccgtttaccatctgcagtcactgcagtccactcgtcaggccatagacggtcacgccaaagtcctgtgtt

SEQ ID NO: 7896 - DNA, 59 bp, Triticum aestivum
  Clone ID: LIB3281-060-P1-K1-F8
cggacgcgtgggcttggctgacacatcattcgtccaagactccagtctcaggttttgct

SEQ ID NO: 7897 - DNA, 455 bp, Triticum aestivum
  unsure (1)...(455): unsure at all n locations
  Clone ID: LIB3281-060-P1-K1-F9
cccggggcgacccacgcgnccggnacaaggnnanncctggcccagcagtcaagcctanganngnagngcagnacaggggagaggacaagcagnngggagcngaagaaannncnnccaagggccccaacaagaagcgngagaacgccgaggcttacctaggagtaactattaagaatgctgttgtcaccgtgcctgcttacttcaatgattcccagaggcaggcaaccaaggatgccggtgttattgctggtcttaatgtgatgcgtatcatcaacgagccaacagcagctgcaattgcctatggtcttgacaagaaggctaccagtgtcggtgagaagaatgtgcttatctttgaccttggtggtggcacttttgatgtctccctccttaccattgaggagggtatttttgaggtgaaagccacggctggtgacactcatcttgggggggaggac

SEQ ID NO: 7898 - DNA, 221 bp, Triticum aestivum
  Clone ID: LIB3281-060-P1-K1-G10
cggacgcgtgggcgccacgccaaggtagaggagtatctcggaaagcaccgccagcgccggagccccccgcgaatccgggcccggatctcccggcccggcggcgatggcgctctccgacctctgccgcgactcgctccttcccagcttcctctactcctcgcgctccttcgtctgcgccgtcccaggcttgctctactccccgatgacctaccaggcgcccg

SEQ ID NO: 7899 - DNA, 441 bp, Triticum aestivum
  Clone ID: LIB3281-060-P1-K1-G11
ggaggccgagctcgacaagttcaattctttcttcgtcgagaaggaggaggagtacatcatgcgccagaaggagttgcaggacagggtcgccagggcggccgggatggagtccagggaggagctgctgcgtgtgcacaaggagatcgtcgacttccatggcgagatggtgctgcttgagaattacagcgccctcaactacaccgggctggtgaagattctcaagaagtatgacaagagaactggggctcttatccgtctgcccttcatccaaaatgtgctgcttcagcctttcttcaccactgaccttctgtacaagcttgtgaaagagtgcgaggccatgctcgaccagctcctgccatcaagcataccatctgtatatattgaaagagggaaaggaagatggcaacactggcgaccagcctctgaaccccagttcttcct

SEQ ID NO: 7900 - DNA, 384 bp, Triticum aestivum
  unsure (1)...(384): unsure at all n locations
  Clone ID: LIB3281-060-P1-K1-G2
ctggaatggccgtgtctgttgccttgcagcctgtaagggtaattgtcgagaaaaagagagctgatgttaaacaaaggagagtggtcntcactnncatgggtgtagtgacgccactgggtcatgatcctgatgtgttttacaacaaccttcttgacggtcatagtggaataagcgagattgagacgtttgactgctccaagttccccacgagaattgcaggagagatcaaatccttctctactgaaggttgggttgtacccaagctatctaagcgaatggacaagttcatgctgtatttgataactgctggtaagaaagcattggaaaacggtgggctcaccgaaaaagtcaagaatgacttggataaaaccagatgtggggttc

SEQ ID NO: 7901 - DNA, 123 bp, Triticum aestivum
  Clone ID: LIB3281-060-P1-K1-G4
cccacgcgtacgcccacgcgtacgcggacgcgttttcagttcttggctcccggtccgggcccgttgggttcattagggtttagttgtagcgccgaaaaagtaggaatggcggactttgagttc

SEQ ID NO: 7902 - DNA, 436 bp, Triticum aestivum
  unsure (1)...(436): unsure at all n locations
  Clone ID: LIB3281-060-P1-K1-G9
cggacgcgngggnnnnnnnaggcaancaacacacatangannnangcannaagaggaaagaggcggnngnngcggggcaggggcaacagggaaaggaggacgaaaacananngcangaaggccaagnnaganagcagnanncagcaggggacnnnngagancngncanccnggactagcanangcaaganagacactagnannnagaanccagcancacacttctatattacttcatcaaaagaagataattgtctgccatcagctatctccgatgagcatttggtttttaatcaagtttgcgacgtagtcagcaacccagaaggatccagcctccgtgcagcagtagccgtgtgtatgaccttctttctcgaccgacatggcaacccctggagcatgccttgagatctcttccaagtgagtcagtggaccccagt

SEQ ID NO: 7903 - DNA, 422 bp, Triticum aestivum
  Clone ID: LIB3281-060-P1-K1-H10
cccacgcgtccgcccacgcgtccgcccacgcgttcgctcgccttcgccccaaagcccttgttccccttccttctggagcggcggcggcaaaggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaagcctttgttcctttgtacttttcaagatgcaggttcttatgtcagtgcttaagaggtgcaaaatgcg

SEQ ID NO: 7904 - DNA, 377 bp, Triticum aestivum
  unsure (1)...(377): unsure at all n locations
  Clone ID: LIB3281-060-P1-K1-H11
cccacgcgtccgcggacgcgtgggattccgatccagcaccgccgccgcaaacgggacacctggagagccctcttggccggtgaagtancaagcaagatggctggaaggaagggaggcgacaggaagaaggcggtgacccgctccgtcaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagcttgccggcaacgctgccaaggacaacaagaagacccgcatcatcccgcgccaccttctgctcgccgtccgcaacgaccaggagctcggcaggct

SEQ ID NO: 7905 - DNA, 388 bp, Triticum aestivum
  Clone ID: LIB3281-060-P1-K1-H12
gaggaagaagagggttctgctacgtggcatggaattcatggcatagttggttctttcttgttgctcttcctacctgtggctgttgctcttccttcttcgcaagcaccagtctctccgccctcgcagccagccgctgccgagagggggccgggaggtcgccaccgccggctgctctctgccacgccgcttcgaccagagacaggtgagatggaaggtttcgagttcttccaaatcatacttgacaactcctcgagcaggctgaggctgcctgacaagtttaccagggtgctgctagacggcggcaagccccaggaagtgaagctacgggaggccggccatgggcgtcgcttctgggacgtgaaggtggtgctggacgcccgcggccaca

SEQ ID NO: 7906 - DNA, 366 bp, Triticum aestivum
  Clone ID: LIB3281-060-P1-K1-H6
cggacgcgtgggtgcgtcattgcctagcacccaagaatctgtacaagatgaagaggctgagttcgtagaagattcagccccgattatcacccctataacttcaaggaaggataccgcgactcaaactagtccagatctaagtaggtcttcttcgcccagtgccaggccttcatttgttcgctcattctcaatgcaacaagccaaagagagggagagctgtttctctgatcttgagatcagggatgtgcagatggatgagcgagtgagtcttaccagatggtccaagaaacatgtaacacaaggctctaacaagaattctacaaatatgttagagtggaataaaaagacggtggactctaaatcttc

SEQ ID NO: 7907 - DNA, 658 bp, Triticum aestivum
  unsure (1)...(658): unsure at all n locations
  Clone ID: LIB3281-057-P1-K1-A1
cgnntccgctttgctttaagaagnngataaagnngcgccacttctggtattctccttaatgtgcanngcattcnaaaaaattgtggagtgccattctaancnagaggagaaggcgctgnnttgcgagnanngaagttaccacgatcnnaaagannaataaaccatannggggaagggcgttgtatcnncctcgacctaattcnnaatgttcncnntggtgatacggcncnntgtaagaacgaaccctaagnncagaagtatttctgaccganggtganntcgtacctcncnaagaaaggacnnctgtattttcagggaagccaaaccatgcctccannnatttcgannaatggnngataaaccacccatacttgnnngtcgagacatntnnctgaacgataananngcagatctttcaagaagaacgatgananntctgataattctccaagaaactgtnntgtggataaacannatcgcaggtgcacaagttcttaacaatgatnngttgttttgaccgaacggtgaaggcctctttactgcaagnnggagaccccannacttcaatcattaaaatttccaagacnccatgttcttgaacccagaagagcacantgccaagtgaatcaacccaatttaccgaagaggccaaataatg

SEQ ID NO: 7908 - DNA, 539 bp, Triticum aestivum
  unsure (1)...(539): unsure at all n locations
  Clone ID: LIB3281-057-P1-K1-A10
atcccattcatccccacagccagaggagagttttcatggcgagcaccaccaaagcagcgtggaaaaacagcaggggctgccggcggcggctagcttgctgcatcctccgcccaacccagtcaatgttgaaaacaaagaggacgatggtgcgcatggtgtggggcggcggcgcggaatcccgcggggctgcgtggtagtggccaccggagctgcagatgacgacggtgttggagatgggttgccactcgtcgcacatgctacaatcgggaagctgaggagaggagcagggcaacatcgggctccggcggcaccgcgtgctgcgtcgcaacatcttcgtcgccaccgcctgattcgtcgcagcacctcgcctccgtcgcgttgtgctgcagtgaagcttcgccggctcccatcgggtgcggcgaggttgtaatgaagcgtcgtcnaagctgcagtgaagcgccgcggcggtcgtcggagctccggcgaggttgcaacgaaacaccgtccaagctgcatagaagcgccctcggcggtcatcc

SEQ ID NO: 7909 - DNA, 393 bp, Triticum aestivum
  Clone ID: LIB3281-057-P1-K1-A3
cggacgcgtgggctgcgatgctcctagacaaattggtggttgcgatggatacacggaaacgcagtcgtcatcaaggcgttcgtgcggagacccagggatggtatgacatttgatgcagacttgaaagtgatggagcgcccccctggtgaatgcgatcttttatttaaaaacaggtggacattgccccagccagagatgtattattgggtccccgcggagacaggtgaatgggttgacgaatcagactaattttcagcagcgggtgtatgtcgttttttctgtataatgtcgcatgatcagaaggcgatagtgatactaatcttccatcgctgtacaatgattcagttgactggggaggcatgtccgccagatcgaagagatgttgttctaagt

SEQ ID NO: 7910 - DNA, 444 bp, Triticum aestivum
  Clone ID: LIB3281-057-P1-K1-A4
gcgtccgctcccaagcagttcgtcacctcaaccccgagtcctctatccccacccgccagccatgatgggccgtactaagcaggggggggggcagtccaccggttgcaaggcgccgcggaagcagctcgcgaccaaggcggcgcgcaagtccgtcccggccaccggcggcgtgaagaagccgcaccgcttccgccccggcaccgtcgcgctccgggagatccgcaagtaccagaagagcaccgagctgctcatcctcaagctgccttttcagcgcctggtgctggagatcgcgcaggacttcaagaccgacctccgctttcagagctccgccgtctccgcgcttcaggaggccgccgaggcctaccttctggggctgttcaaagacaccaacctctacgccatccactccaagctctttaccatcatgcccaaggacatccatct

SEQ ID NO: 7911 - DNA, 591 bp, Triticum aestivum
  Clone ID: LIB3281-057-P1-K1-A7
cggacgcgtgggcagccccctggagctcgtgttatccacacctattgccttatgcagagggataccttggatggtgatgcttttgtcgattcaccaaccggcagtccatcaccgtggaactctcattcgctggatcaaataacagatgctgatgtttcccggatgagaaaaaaagtggggcagcgctcagatgccttttggtggtgccaatgcatctcaacagccacgtaaagatgtcccaaaagggtttaagaagctgctgaaatttgggaggaagaataggggtgatggtttagtgaatgactgggtttctgcttcaactgcctcagaatgtgatgatgatatggaagatggccgggatctggcaataggatcctctgatgatttcagaaagtcaagaatgggctatctttcttcatatgatggttttgttgagaacgaggttttgactgaacaagaacaatcgctgcgcatctccattccaaacccgccttcaaattttagactgagggaggatcaactgactggtacctcaattaaagcaccacgttcattcttctccctgtcgacatttccgagcaaaagaggcga

SEQ ID NO: 7912 - DNA, 486 bp, Triticum aestivum
  Clone ID: LIB3281-057-P1-K1-A8
cggacgcgtgggccccatcgcccccctcccgttcccgagcgcgagagaatccgaggagaggagcggcgcaaggaggcggtgatggagtcggatcagggcaagctcttcatcggcggcatctcctgggagacgacggaggagaagctgcaggagcacttctccaacttcggcgaggtctcccaggccgccgtcatgcgcgacaagctcactggccgcccgcggggcttcggcttcgtagtctacgccgaccccgccgccgtcgacgccgccctccaggagccccacaccctctacggccgcacggtcgatgtgaagcgggcgctctcgcgggaggagcagcaggctaccaaggcggtgaaccctatcgcacgaaggaacactcgaggtggtggcggcggcggcggcggcggcggcgataccggtggtgctaggacaaaaaaaatttttgtgggcggactgcccttcaatatgacagatgaagagttc

SEQ ID NO: 7913 - DNA, 441 bp, Triticum aestivum
  Clone ID: LIB3281-057-P1-K1-A9
cggacgcgtggggtcagcttcttccgttcatttttccgagctttctagattcaacagcgcttctgctcgtctgagtgggaggagtatcgatgctttgcttggcctcccaccaatggtgaatccgagttagtttgccgacttgccgtggaagaaaggaagagaaaccgccggcgaggggcagaaaaagatgcggggtttgagtaggcttggcgtcgggctcacggtggtgtccgcgctcctcctcctcgcgctcgccgcggagctctactacctcctcgtgcacaagcgccgccagcgacgacgcgccgccgccgtcttcgacgcggcctcctcgccctcctcctcctcccgcgagctgctccagctcttctgcttcaagaagccagccgcactcgcctccacctactcgcaggagccgaccgaaaccgtggccgaggtcgt

SEQ ID NO: 7914 - DNA, 432 bp, Triticum aestivum
  Clone ID: LIB3281-057-P1-K1-B1
cctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatttttt

SEQ ID NO: 7915 - DNA, 598 bp, Triticum aestivum
  Clone ID: LIB3281-057-P1-K1-B10
aggaaatccatgcctacctgacaagagtaatgtttaacaggcgcaataagtttgacgcgcgatggaactcgctggtgcggggtggaatgaaaaagggcccaaagggcgatgagaagtatcttggcatggttaacatgattggtacacactttgaggagaaccacattgccactggatttgggaaccatatggcaatcccaatacttcgtggtgaatggcgcgaggacatgacttttgaagaagccgttaagctgattgagaagtgcttgctggtcctgctgtaccgtgaccggtcattcatcaacaaattccagattgccaagatcacgaccgagggatcaaccatctacccgccgtatgctctgaagaccaactgtgggtttgccgactttgagaacccgtccaagggtgctgtaggaacatggtaggccatgagcttggaaacgaagcaaactgtgctgctgaaacagtttcagcccttgtgagcgtttgatccgaatatgactgaagtccacattttctctgtatgacatgtttataatttgacttaaaaatctttgtgaacgttaaaaaaaaaaaaaaaaaaggccgccttttt

SEQ ID NO: 7916 - DNA, 452 bp, Triticum aestivum
  Clone ID: LIB3281-057-P1-K1-B11
cggacacgttttctaaaatcacaagccactttctgtcggctcaacctcctccaccgggcgtcatattaccggggtatcgggccgtcaataaactcatttcttcccccgacccgccctccctaccccaccaacagagccccaaaccgggttcccctctacttctactcctccccccaccccacccagcccaccttcgtagaaccacaagcgcatacagattctaaccggataactctatctgataacataagctttcttatctcggcctaatggccgatgaaaacgtgactcttcacacgattacgacctccttccgtggaccacaatctccgcgccatatctacactgtggctcaccgttatctcagaatccatcgtctacaacttgtccacacccttcattaataccaccgcaatcttatccacaccagactttatcctcagtccctaacc

SEQ ID NO: 7917 - DNA, 621 bp, Triticum aestivum
  Clone ID: LIB3281-057-P1-K1-B12
ccctgatctaccttgcagggtcagcttctgttttggtaattgctgatatcgctctgcgcccctttgaaggtggcaagggcggtgtgcagacacagcctggatttgctcgtgggttgagtgatgggcttcccaagttcatcaaagctgagggagctgctgggctctacaagggcattgttcctctctggggtcgccagattccttacaccatgatgaagtttgcttcctttgagaccattgttgagcttatctacaaacatgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctacagtgggtgatgctgttaagaagattggcatgctgggccttttcaccagaagacttccccttcgcatcgtcatgatcggtactcttaccggtgctcagtggggaatctatgacgccttcaaggtcatggtccgactcccgaccaccggcggtgctccaccagttgcttccggtagaggaagcaaccaaaagccatcagtttgattgatttttt

SEQ ID NO: 7918 - DNA, 577 bp, Triticum aestivum
  Clone ID: LIB3281-057-P1-K1-B2
cggacgaggtaagaagcagcagccgcagcgcgaccccgcgagaaaccctaccgccgccggcgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgc

SEQ ID NO: 7919 - DNA, 579 bp, Triticum aestivum
  Clone ID: LIB3281-057-P1-K1-B3
cggacgcgtggggcctggggctggagcgaggagtctcattgggcacgaccgcaccaaccggagctcccgatccacagccgtgcactcctccctcctccctctcacagccgccacaccccattcctctcttcctcctccctactccttaacggatcccttccaccgccacacccactcgtctcctcctctctcttctagctaactcctccttcctgatctctgcgtcagccgcagcgcgagaggagcagcggcagcggagatgctccgatggcggcgtcgagttgtgaagcggtggtgcctgggcgcgagtcgacagaagccggagcggctactccgggccccgatctggggggttcggttccagggcgccgacagcttctttgtttatgacgcggggccgtgccgccgggggaagccttggatccatgcaggggggctccccggggggcgcagaggagggggttggacgagcgggtgaggatgcgtgaggccagaaggagtttggggttgccagagaagcatgggccgcaccggggctggtcatcgccagagcaaaggggaggaggtccatgcaaggga

SEQ ID NO: 7920 - DNA, 613 bp, Triticum aestivum
  unsure (1)...(613): unsure at all n locations
  Clone ID: LIB3281-057-P1-K1-B5
cactggaagaaaaaggagctctgaagaaaatgtctgtgctgaacattcattgcctgagaaaagagcaaagggacctagaagcccagtaacatcacgaaaacaacttccttgtgtatcattgtcttctcgtatggcagaagaaagtcagagtgaggctcatgatagtgcacaatcattaagtgatgattggaacaaggtagtattcagcgtatctgattccatgaagcaaatgcatatacgcccagaatctattagtaagcttaacctacaacagcttgatatgttaggagatatgctggggaaggttcatgtggctagaacatataagaggcttcctgctgctgtgaggatgcaagatcccagactagctgaggcaatgactctccatggcaagctttcatatgaaaaggcaaaactgcaaataaatcgtgttaaacttgataaactgcgaaacaaagcacaactatgtcaagttggaattcaagaatgccgctatttgaaatccaagatttcacagcttcgtcgtcctacaatgggtgctgcacagatgaagggaggtcctctntatacagaaaacttgattaatacctgtgacagactggaaggaaatgct

SEQ ID NO: 7921 - DNA, 608 bp, Triticum aestivum
  unsure (1)...(608): unsure at all n locations
  Clone ID: LIB3281-057-P1-K1-B6
cttccgacatgccgcagtggaaggtgctccatggctgttttcgtgtcatcgggtacatttgatgggggccaaggcttccaagctggcgaggcttgtggaggacattgtggagagtgtcgccaaatgtgggtctgtccggctgtcactactggtggattgcggtgctggtacacggagatcaacgggaaggtggcaatcgccgggacccacttgagcctcatgcaggaggacatgtacgtactaacataaacaagatggcagataagttatctgctcttcagctcaaagtgacggaggtgaatgtgttgttcaccatgaagcagaatcactcctccaaagacctgctaggacagcaaggacaagtgcacgatggtgcaccgaagcatcacggtgaacatggtaatgtcaggttgttgatggagcgatacaaattggtttgaaggccgggtaccacgcctccgccaatatcgcgcgcanacattgttgagtactgatggtgtcaaagtttgaccgtagctagcttgatttggagacatttcctgttaggacttaaactttggcttggaggcattgagctttcgctctaactagctttggtacttggtata

SEQ ID NO: 7922 - DNA, 432 bp, Triticum aestivum
  Clone ID: LIB3281-057-P1-K1-B7
cggacgcgtgggcccaaatctcctcagcctttttcgcatctcctccgacatggcccggagcaagcagacggcgagggagtgcaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatacgaaagctccccttccagtgcctagtccgcgagatcgcccaggacttcaagaccgacctgcgattacagtccttcggcgtgttcgccctgcaagaggccgccatggcctacctggtgggcctgtacgaggacaccaacctctgaggcatacacacacagcgcgggaccatgatgcccatggtcatgcagatcgc

SEQ ID NO: 7923 - DNA, 610 bp, Triticum aestivum
  Clone ID: LIB3281-057-P1-K1-B8
cggacgcgtggggtgatgtgatcgcggaggacttagagagagagagagagcaaggggggcgagacgacgcaggaatggggagtgccaccacctacgcggagagcatcgcttcctgccgcactccagctcccatccgctccccatccctcgcagccacggcggcggcggtccccgacgcagcccccctccccgtgaggcggcagctcgatttccccagcggcgacggcaacacggatgacgatgatgaccttttctttctcgtcgcagaggagatggagcgaaacctagaccaggtcacgcgccgcgccgagcagagcttgacgccgccgacggttgcgctggcacactcggctttccgtgagaagctgtgcatttgcgggcgcgggccgtgtgccgttgagtggaaggagggaggatgggcatacgtctgctcggcgccgccgaagtgcagacattcttcttattgcatggactctgatgtcaatccaagttcacagcctgcctttttgagtcatcatgaaccccacaatcatatgactaatggcacaactcaagttaatgttagtccccaggcgctggtgctacaactccaataaaagttacttcccca

SEQ ID NO: 7924 - DNA, 476 bp, Triticum aestivum
  Clone ID: LIB3281-057-P1-K1-B9
cggacgcgtgggcggacgcgtaggctcccttatgcctatcctcttcctcgccacccgccgatcccaccgggcacggggtgcccgctaccgcctccgcctccgcctccgcatcccccacgtcgccaccgccgccggcgctgccaccgctccgggaaacagcttcgccgtcgaggactacctcgtcgccaactgccacctcacccagccgcaggccgtcaaggcctccaagaacctcgcccacctcaagtccacctccaaccccgacgccgtcctcgcattcctcgacggcctcggcttctcccccaaggaggtcgccgccgacgtcgcctccaacccgcgcatcctctgcgcccgcatcgagcgctccctcacgcccatctccgcggagctccgcgccctcagcctctccacctcccaagtcgcccacctcgccaagatcgccgacccctacttcctctaccacaacttcctctcca

SEQ ID NO: 7925 - DNA, 557 bp, Triticum aestivum
  unsure (1)...(557): unsure at all n locations
  Clone ID: LIB3281-057-P1-K1-C1
cggacgcgtgggcgcgacttcctcaccctccctctcggcggcggcggcggcggcgacggagcctaagaaccggcggcggcgacggcgactcctctcgtcccaacggaatacttcgatttgccgaggcgagctgttcttgtcttctcacggcgtgggtgaactgcggaggcccctctcgagtctcgaagcaaacgcgcggggagaggcgccgagatgtttgcgacggcggcgcggtgggcggcgaagaaggggaagcccaagatggcgccgatcgagctgacgacggcgccggagcaggcgcagtccatcacccgcaccatcttcgacgtcgtcaaggagcacggccccctcaccatctncgacgtctgggagcatgtcaaggacgtagggctgaggggtttgacaagcaagaggcagatgaagatcatgctgcggtggatgagggagaagcagaagctcaggcttatctgcgaccatgacggaccacacaaacagttcctctacacgacatggttcaccaaccccaagaacgccccgcaaaggcccaagagggagct

SEQ ID NO: 7926 - DNA, 574 bp, Triticum aestivum
  unsure (1)...(574): unsure at all n locations
  Clone ID: LIB3281-057-P1-K1-C10
acgcgtccgatnggaacctgatggtaatatatcgagcgagtatttctttctccctgacgagaacagngagacacgangaaaatactagtgggtggggggtctacaagaggaaaaatatgtttcatcacacgtactgctcacatcgacagaatactatgacgaccaacggccctcagcagaacagagctgagccaaacgtacatactgcaacatcagtggccgccgccgatcccgccaccgccacctttgccgatcccgaaaccgaatccgcctccctcgcagcccttcaagggcgcccgcatctccggctccctccacatgaccatccagactgccgtgctcatcgagaccctcaccgccctcggcgcctaggtccgctggtgctcctgcaacatcttctccacccaggaccacgccgccgtcgtcatcggccgcgactcggccgccgtcttcacctggaagggcgagacccttcaggagtactggtggtgcaccgagccctgccttaactggggcgccggcagcagccccgacctcatcttcgacgactgcggcgaccccacccttctcatcc

SEQ ID NO: 7927 - DNA, 544 bp, Triticum aestivum
  Clone ID: LIB3281-057-P1-K1-C11
gttggagtcaaatatgcaacaatcaaatgtttttgcaaaactaggactgagtattgggggggtaattcaggagtgcaggggattttactttgcaggtatggagacaacatcagtcttgctcacatggacactaattgtgctaagcatgcacccagagtggcaagagcaggcaagagaggaagtgttgcatcactttggaagaaccacaccagattttgagaacttgggtcgccttaagattgtaacaatgattttttatgaggttcttaggttgtacccgcccataaccttccttacgagaagaacttacaaggcaatggagcttggcggcatcaaatatccggcaggcgtgaaccttatgctgcccattctctttatccaccatgaccctgatatttggggaaaagacgcaagggaattcaatccacagaggtttgctgatggcatctcaaatgcagcgaaacatccggcggcgttctttccttttggagggggtcctcggatatgcatcggccagaactttgcattgctggaagcaaaaatg

SEQ ID NO: 7928 - DNA, 573 bp, Triticum aestivum
  unsure (1)...(573): unsure at all n locations
  Clone ID: LIB3281-057-P1-K1-C12
cccacgcgtccgcggacgcgtgggattccgtattcagcaccggcgccgcaaacaccacgcggcgagagccctgttcggcggggaagtancaagcaagatggctggaaggaagggaggcgacaggaagaaggcggtgacccgctccgtcaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagcttgccggcaacgctgccaaggacaacaagaagacccgcatcatcccgcgccaccttctgctcgccgtccgcaacgaccaggagctcggcaggctgctcgccggcgtcaccatcgcgcacggtggcgtgatccccaacatcaactccgtgctgctccccaagaagtcccccgccgctgcagagaaggaggccaagtcgcccaagaagaagaccaccaccaagtcccccaagaagaaggtcgccgccaaggagtagcctcccctagcttagctgactcttaattccatatc

SEQ ID NO: 7929 - DNA, 585 bp, Triticum aestivum
  Clone ID: LIB3281-057-P1-K1-C2
cggacgcgtgggcggacgcgtgggcacacatgtgcgagtggagggcaagatctgcagctggcgccaaggccgccatattcttgcgacactgcgagcttctccggccgccgcctgcgttgctctctctctcgttctcatctctcaatccacccatggtcatggggaatcataagctcactctgaagaccgaggaggactccaatcctcgtgataagtacataacttggactgacgaggtgacaaggtttatgcttgagtggtatatcgaccttcgtaaggacaaacctgcaactttcaagttcaagaaacaacaccacttgcaatgtgttgatgctctaaatgccaagtttttgcttggtgtcactcaaacccaagtggatcgacactatcgtcaatgcaaggagaagtggggttgggtgcgtcgtgcccttgacagaaccactttcacattcacactttccgggtcataaaagcaaagactcaataaaactgctgtcaattatcttactagacccattaggttctttcatcaattggaagagttattcttggatcaatctcatgccgatggctcactttcacttg

SEQ ID NO: 7930 - DNA, 532 bp, Triticum aestivum
  Clone ID: LIB3281-057-P1-K1-C3
ggtcattcttgctgcaggcgacaaggcactatattttgatatggtccctgcatttgatgtggttgggaagaagtgattctggtctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggtgcaatcgcaaatccgatgttcaagatgaaagggccttcaatgctgcagggcagctacaatccagcatttcccctcaaacatcagcagaaggatatgaggttggctctgtcgttgggagatgaaaatgccgtgtccatgccagtggcagctgcttccaatgaggcattcaagaaagcaagaagcttgggacttggcgacctggatttttctgcagtgcacgaggtgcctgaaaggcacaggtggttcacgctaaagcctgatcgggggctgaatgtgtaaaaccacatgccattgggcatata

SEQ ID NO: 7931 - DNA, 448 bp, Triticum aestivum
  Clone ID: LIB3281-057-P1-K1-C5
cccacgcgtccggcgagccactcgtcggcgaccaccagcccgtgtgcgcacacggggtctgatgcgcggcgccgctgatggggattgggcgtgacctgcacctggaggaggcctcgacctgtagctagaagaggcctcgacctgcagctggccgcgcgccgccacactagtctacaacctacagctggcgccgcacgcccaggccgttcaactttggcacaccaggtcgttcaactccgcccgtgctcctcttagattaccttcagtcaagattgaacacaaaatatcaatccattcggtacagtgcggttgtctcgattagtctttcttgcaaacaaaaaagaaatgcccgtaccttttgcaggtatgaaatggggagaaaatgtgaactaccctgtggaaatcttaaaatacatgcccgtgcctatttctctttgtttttgctgtg

SEQ ID NO: 7932 - DNA, 618 bp, Triticum aestivum
  Clone ID: LIB3281-057-P1-K1-C6
cgcgccggtggtcgatggcgacggcgacggcgactgcgagctcttcgactgcgccatctgcgatggagacggtgcccggcgtgcgcaagttcagcgtcggctcgtgcggccacgccttctgctcgggctgcgtcgcccagtacgtcgctgctaagctgggcgagaacgtcgctcgcgtcaaatgccctgaccccagctgcaagaacggcgccgtcgagccggagagctgcttcggcatcatctcctcggacctgctcgacaagtggggtttcctgctgtgcgagtccgcgctcggcggcaagaagatgtactgcccgttcagagaatggtaggcgcctcttctcgccgacggcgagggcggggcggcggcgatcgcggaggcggagtgcccgcactgccacaggctgttctgcgcccggtgcgcggcgccgtggcacgccggcgtcgggtgcaaggagtttcaggagctcggccaggacgagcgcggccgggaggacttcctgctgaggcggctcgccggacggcagaagtggcagcggtgcccccaaggcaagatgtacgtggagaaaatcgaagggttccactacattaaaaatgcagttgtggatgcaactttct

SEQ ID NO: 7933 - DNA, 589 bp, Triticum aestivum
  Clone ID: LIB3281-057-P1-K1-C7
ggaaaaggaaaccctaagctcgaggaaaaggttacccttagctcgtcgttgatggggagacgactcaaaagcaaacgcgggggcgtcgtgcataatcccaggacacatgaggaggatcgctcagtcgcgttggcggcggcagaggcggcggcggatgaggcccgttctgcggcggacttgtgcccctactgccgaacctgccggtctcgcgttgggcctggcggcggcggcccctgcccctgttccgacaccacctccgcccaaccgtctgccccctcgcgcggtagcgccgtccccgcccaaccgtgccaggatcatgtggccgagcctccatccgcacgggctcagccgcaaccgtctgtctcgtacttgagcatcttgctcggcactacaacactcaaggacactgccacttcctcatcctccccacaggctgtagctgagaccccgccacccaagccaaccatttatgtcaacgaccctcctgattggtacttcaatatttacatcaggatcgatcgttcaagatctttccacacatatcctcatcttggtggaccattcaagagccttgcaggaaggtttaaaa

SEQ ID NO: 7934 - DNA, 475 bp, Triticum aestivum
  Clone ID: LIB3281-057-P1-K1-C8
aaagctgcaagatttactgccgacaattattattcaactgggccctgataacttgggcggcctgcggaggcttgccgagcggtttcagaagcagatgcctggcggtgaggctggcggcgccagcatcggtgctgcccaggacgacgacgacgacgttccagagctcgtcccaggagagacctttgaggaggcggcagaggagaagaaggaacccgaggcgaagaaggaagcggagccggaggagaagaaagagtcgtcgtcgtaatcttgtcacgccattcattgctgtgaagggttccttgttggttgagggttgattggcatcttattactgtatatgccggagacatggtcctgtgagatctctgccccgtctttcatttctagcgcccctcccattggttctgtctcggccgtgcgttctgcccgaaccaccgtcggcggaaccgagtttgacgacaattatcggttacct

SEQ ID NO: 7935 - DNA, 216 bp, Triticum aestivum
  unsure (1)...(216): unsure at all n locations
  Clone ID: LIB3281-057-P1-K1-C9
cggactcgtgtgctaaaaccacgagccactgttcnttcggcgcagcctcctccacccgccatctcttaccgcggtatcgggccttcaataaactcatttcttcccccgccccgcccgcccgcccccaccaacatatccccaaaccggcttcccctctacttctactcctccccccacccaacccagcccacccttccataaccacaatctcacaca

SEQ ID NO: 7936 - DNA, 553 bp, Triticum aestivum
  Clone ID: LIB3281-057-P1-K1-D1
cggacgcgtgggtgcgtctcctcctcctttccctaacccagaccaggagcgccctctgtgcgccgccccctccccccaggagaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatga

SEQ ID NO: 7937 - DNA, 501 bp, Triticum aestivum
  Clone ID: LIB3281-057-P1-K1-D11
gggggggaaaaggggggggggggaacaaaaaaagggggggggggggggggggggggggggggggggggggggggggggggggggaggggggggggggggggggggggggggggagggggggggggggggggggggggggggggggggggggggagggggggggggggggggggggggggggggggggggggggggggggggggggggggaggagggagggggggggggagggggggggggagggggggggggggggaggagaaggggggggaggggggaggaggggagggggggaggggggggggggggaggagggggggagggaggggggggggaggggaggggagagggagagagggggggggggggggggggagagggggggggaggggaggggagaagggggggggaggagggggggggggggggggggggggaggggggggggaggggggaggggggggaggggagaggggagagggggggggggggggagggggg

SEQ ID NO: 7938 - DNA, 548 bp, Triticum aestivum
  Clone ID: LIB3281-057-P1-K1-D2
cggacgcgtgggtctgaattgatttcctttgtgtttatgttactaatagtggtgagggcgagattcccacctgcgcaggcgggtggaaacatgggttcctcgcaagaatccacattttcatctgcctcaaccgccgcacaagtgaatgctttgggcttactacctgtctatgccaaggagcttattgctggtggtgcagctggtgcattcgcaaagactgccgtcgcgccacttgagagggtaaagatcttattgcagacaagaacccaagggtttcaatcccttgggattgtccaatccttgaggaagctgtggcaatacgagggaattcgaggtttctacaaaggaaatggtgcgagtgtgcttcggattgttccatatgcagcattgcattacatgacatatgagcagtataggtgctggatactgaataatgcgccatcagtgggtacaggacctgtggttgatctgttcgctggctcaactgctggcggaactgcagttctgtgtacctaccctttagacttggctaggaccaaacttgcata

SEQ ID NO: 7939 - DNA, 565 bp, Triticum aestivum
  unsure (1)...(565): unsure at all n locations
  Clone ID: LIB3281-057-P1-K1-D3
cagaaacatcaaattatatcgaagctggacctatataagatatggctcatgtctgacgatcacatgcatacatagagggttgaataatacagcaaagataaccgcaatctaccaatccatccagtctaattatatactagccagcaaagcattgcccaaatggagtaactactactagagtcgatctggatactaattaacactacaccagttactagattcgcaaatatggcactactccatatcagtcgtcacagcagaatcaatgcatactctagagtacgccctagaactacgctctcatcagtagtacctcatgagctgatccacgaacatgatcagaagaaataggctacgtacttcatgccccacccatcacctcccagaagggcccggaagctgaggaggtcgcccaccacgaagaagcagaagcccgcggtgaagtagatcctgccgaagatgtatcctgggtcggcggtgaggaagacccagacggcgctggcgaacaagcaatggaagaggacggtgaccaccancgcgaggtaggcgagggtccggcgggccc

SEQ ID NO: 7940 - DNA, 606 bp, Triticum aestivum
  Clone ID: LIB3281-057-P1-K1-D4
ccgctctcccaaaagttcttcttgttccgcaaaccacacgaagaaaaatttgcaaaggagatggcgaccacgaatgggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgtttgttttgtaaagacaatt

SEQ ID NO: 7941 - DNA, 532 bp, Triticum aestivum
  Clone ID: LIB3281-057-P1-K1-D6
agaatttatgacctggaggctcataataaaagggaaacatttctttgttccaaagctaaggcaggacgatcaattcaaattaagttagatacagagagtagagttagacaacaaaatcaagccagagcgccagtgagagataaggaacctatacagttcaactaaagcatactatttgataacttcacttgactgtcttgtcgttcaacttctcacatggcacgtcacatgaacctgctgtgagtttttagtttaaccaatcaagccatagaaaaaaatcatggataatacgattatgttcttttaattgaccgcttgttgatagtgagcgatggtttgccccatagtttgcagcatattggtcctatgcgtaagagtggagtttaacatgcgaagaacaatctcttattacggtcctctcacaaagacatggttcgctacatggagctcggccccttgtctttttggcacgttggcgtttatggcggcgcttacctccggagcgaaccaatgtactcttccctggattgct

SEQ ID NO: 7942 - DNA, 611 bp, Triticum aestivum
  Clone ID: LIB3281-057-P1-K1-D7
cggacgcgtgggttcagctgtccaaggacctttttcaagaaaaacaatgcaggctcggtgtgttaaatataatttccagagcatggactacagaaatcatctgtcctgcagcatatgactactattatccagccagtactggaaaagggtattgttgagtattccatagtacacatggtcatatcggagtacttaacaattgcggataagctttggatgtgattcgtcagttaatcccccatcttatccaagggtcatctgtcctagatgaagatgtgattggtcaattaatcccccatcttacaccaacgaaatcaaaagcgcagaagaaaagatcaaaagcgaagaagaaaagatcttcagaactacttctcattcggatcatgcagacgaaggaaggattaaaattagggcttgcttgcctcaagcatggccttgagaaggataggaagaggattatcaaaagcttgaaggggcatattaggaagcttgctctcaatgattatggatgccttttcgttatttgtcgtctctccattgttgataacacagaacttattactgaggttgtagttgatgagctgacaaagcacttaaaggaactcatattt

SEQ ID NO: 7943 - DNA, 553 bp, Triticum aestivum
  Clone ID: LIB3281-057-P1-K1-D9
ccgttttcggaatacccggggcgggcgcacgcgtccgcctctccagtgcggtggagacggtcgtgctttttaggggaaaggcgctggtggccacgggcctaagcatcggcatccgggggggcacctacgcgcgcatcgcgccgaggtcgggcctggcgctgaagcacgccatcgacgtgggcgccggggtgatcgacgccgactaccgcggccctgtgggcgtcgtgctcttcaaccactcggaggcggacttcgccgtgaagcctggcgaccgcgttgcgcagatgatcgtccaggtgatcgcgacgccggaggtcgccgaggtggaggacctcgacgccaccctccgcggggagggcgggttcgggtccaccggcgtctgagctccccgccttggtagataaacctagataactggtttgttgtttaggatggtggtggaaccctaccctaggggaaggtacccaccttattgatggtcgggtccgtcctatgttaaatggaatctcgtgatctctgcccagtttaaactttttgtagagaaattcatgct

SEQ ID NO: 7944 - DNA, 548 bp, Triticum aestivum
  Clone ID: LIB3281-057-P1-K1-E1
cggacgcgtgggaagcgcagcgctttcgtctccgtcgctagggtttcggtctccgcaggggcgatcttccgggagggcacgagccggtgctattggttttggtgcggcggcctgagagagatgccgcccaagtcggttaagaggggcggcgccgcggcggcgaggaaggggtcggctacgaaggccagaccggcgaagccccagccggtcgcggaggaggcgcccgtcgaggtggtcaaggcagcggaggaggctccccctaaggtggaggagcagaagccacagccgtcgccgccaccacagcagccggccgccgaggagaaggccaaggcggatgccgctgagaacggcgcaagccacgctgaagatgatggagctgcaaaagaaacatatgaagaagaggacaaaggtgaacgactggagttcgaggatgagccagaatatgaagaggaggctgctgtcgactacgacgagaaagatttggagcagtatgaggagcaatatgaagacggcgatgaagggttggagtacactgaagatgtaatcga

SEQ ID NO: 7945 - DNA, 612 bp, Triticum aestivum
  Clone ID: LIB3281-057-P1-K1-E10
cggacgcgtgggctaaaaccttaaacccttgtgtcggccactcccccatggcggccgggcgggtcatcctggctcagggggacctccccatcccctcgtggagaccccagctcaagccctcctcatcctatccccgccgcgcggtcgccgccccagcttcgctgtctccgtcgcccctcacggcttccctgcaactcggagatgtgatcgaggcgcatcagttcgatcggcaggcgcttaatgagatctttgaggtggcgcgggagatggaggccgtggagcgcatctcccacgggttccggagccgcgtccttgaggggtacctcatggccacgctcttctacgagccctccacccgcacgcgcctctccttcgaggccgccatgcgccgtcttggcggggaggtgctcactaccgagaacgctcccgagttctcgtccgctgccaagggcgagaccctataaaataccataagaacccgtgaaggttattctcatattatcgtgctgagacattgtgaaagtggagcttccagaaaagcaacagctacctgaaaaattccgggtattaatgcaggtgatgggccctggcgacatgctactcatgcttttt

SEQ ID NO: 7946 - DNA, 533 bp, Triticum aestivum
  Clone ID: LIB3281-057-P1-K1-E11
aaaaaaaaaaagaagaaaaataaacaaaaaaaaacaagaaaaagagagaagcgaaaaaaaaaaaagaaaaaaaaaaaaaagaaaaaaaaaaaaaaaaaagaaaaaaaagagaaaaaaaagaagaaagaaaaaaaaaaaaaaaaaaaaaaaaaaagagaagaaaaaaaaaaaaaaaagaagaaaagaaagaaaaaaagaaaaaaaaagaaagaaaggaaaagaaaaaaaaaaaaaaaaaaaaaaaaaaaaaaaaaaaaggaagaaaaaaaaaaaataaaaaaaaaaaaaagaaaaaaaaaaaaaagagagaaaaaaaaaaaaaagtaaaaagagaaaagagagaaaaaaagaaaaaaaaaaaaagaaaaaaaaaaaagagaaaaaaaaaaaaaaaaaagaaaagaaaaaaaagaagagaaaaaaaagaaaaaaaaaagagaaaagagaaaagaagaaaaaaaaaaaaaaaaaaagaaaggagagaaaaaaaaaaaaaaaaaaagaaaaaaaagagaaaagaagaagaacagagg

SEQ ID NO: 7947 - DNA, 543 bp, Triticum aestivum
  Clone ID: LIB3281-057-P1-K1-E12
cggacgcgtgggtttttgcgcaaaatagctttctatcgctcgatttatcattacaatcggggcatcatcgtctccaagggggaatagccatcagtgcgcagcatcactgttttaattcttaggggcggaaacaaaaatgtatgccaacttttgatttgtttgtgaattctagttaacactacgcagtatacgatattgccaccaatatgaaatcctcacttccagctttcccccagaaaacaagtcttcactttcagctttcctcaaaggaaaaattttccccttcaagcctccttcggtcaaaaggccgtccgcagcagcgatgatgaacttgccaggctgaacccaccatggctgttggttgatgtatgctgaaccttgcaatgttggtttagtttcattcagaagcagggacatgtcttctaacttatagttgtccgcaccgaatccgatcggtccggactgctgtgcgccgcggcctgttggctgcactcctcgacaaccctcgtcggtgtcctagccttgagcatcatctcggcatac

SEQ ID NO: 7948 - DNA, 629 bp, Triticum aestivum
  Clone ID: LIB3281-057-P1-K1-E2
ttctccagagtacttaacagttaaacataatgtccaaattagtaggttaaggacgggtggataatcctcaatttgaaatgtagaacgttggactgaaaataataatatctacggttgttccatttatcgtcacaatacacattcattcagtgaaaagttgatggacagtgagctctttttataattgtgaagattatacaattaccaattcctataacaaatgtattgtattataatttaccagttctagacacacccttctgagttctgaccgttagttcgagatatggatggagccattaggaaacccaattcatgagcatacattatataatatatatgtgtgcattggtgaaaagaagagaaaaaacaaattagccaatgtaacatatgggcaagtagaatctaatcacaatagtaagggacagaaagttgtacaacctgaaatacctgtctgagtggcacatatagtaagcctagatttctttttcttctccttattctactgtatgcggatgtcaatgggtacagtacatccatagtactactagtgctactgtaatatatataaggtgggtaggaataagaatagaatgccaaagaatatgatatggtttttacttattttt

SEQ ID NO: 7949 - DNA, 597 bp, Triticum aestivum
  Clone ID: LIB3281-057-P1-K1-E3
gcagagcagaccaaggcaaaagctcgctctccctcttcctctcaggctctcacacggctgtgcctctctctctctctctcgggccgttcgaactaggaatccgaggtgagcacgggcaaagcgatgggcgcggccaggccgcatcacagggcgccgccggggcgcgtgcccacgaggtgcgtcgccgcgctctgcgccgcctgcttcctcctcggcgtctgcgtcgtcaaccgctactgggcggtccccgagccgccggattgcccaaacaagacgaattctggccgttcgagggctatgctgagccaagcacaaacccgcgaagtcgtcatcgcgttggacagaacgatatcggacatcgagatgcgcctggctgccgccagagccgcgcagatgaggaaccaaggcgtgtcgccgagtgattcagccgctgaccacggaaacatgcgacctagattgcttttcgtcatgggtatcatgaccacgttcggtaatcggaggcgcagagactctatcaggaagacgtggatgccacaaggtgagcgtttgcgaaggctggagaaggacaagggcatttggcatgcgttttggtattgg

SEQ ID NO: 7950 - DNA, 547 bp, Triticum aestivum
  Clone ID: LIB3281-057-P1-K1-E4
cggacgcgtggggtgtggctgaaataattatgttttgaacaatcaagacagccgtgacgtatgggtactaaatagggcccgaatgggtgcgcccacgttggagatgcccttaagagcccacccttacctctcttgcagcctggtcacttcatcgctaatgttggatgttctgcgcctcggacggtcattctgatgagtgataaccaggtcagttctcttacaccgcgatgggtagatcatgcagcaagacttgtgagtgttgggcttcaagatgacacgcatactgagccctctgtgctacgctagaaatactcttatatttgtgaacggagggagtatctatctatctatctatctatctatctatctatccatatcaggggagatgatggtcaaacatgtctgacataaacctgtcttagattattcgaggagctgtgggtatcaaaaacccgatttcctctcttttgggacctttttattctcaccgaatattgacggctctgtcttggatggtcattctgttgagtaataacccacagagctt

SEQ ID NO: 7951 - DNA, 583 bp, Triticum aestivum
  Clone ID: LIB3281-057-P1-K1-E5
attggaactgtgccagtggggcgtgttgagactgtagtcatcaagccaggcatggttggcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgcccagtaccctcccctgggccgctttgctgtgcgtgacatgaggcagacggttgccgtgggcgttatcaaggctgtggaaaagaaggatcccaccggctccaaggtgacca

SEQ ID NO: 7952 - DNA, 534 bp, Triticum aestivum
  Clone ID: LIB3281-057-P1-K1-E9
ggggaacaaaagtactggcgataactttgattttgttcccaacatagatcatacccgggcatttgtaaggaaggatagggagtgaatggctgatctggcttcgggaaaccattggttttcaagatttccgctttgatttcacaaaaggttatgcttcgaagtttgtgaaagaatacattgaggaatcaaagcctctttttgcagtgggggaatactgggacagctgtgaatatgccccccctgacaaccgtctgagctacaatcaggataaacacaggcagagaattatcaattggatagatagcactggaggactttgcgctgcgtttgatttcacaacgaagggtattcttcaggaggctgtgaaaggagagttgtggcgtttgcgcgaccctgaagaaaagccgcctggtgtgatggggtggtggccttcaagatcagttacatttattgaaaatcatgacacaaggtcaactcaaggccattggccatttccatctgaccatgtcatggagggatatgcttatatactca

SEQ ID NO: 7953 - DNA, 485 bp, Triticum aestivum
  Clone ID: LIB3281-057-P1-K1-F1
gaagcccttccagttgagctcatggaaggtagggctggtatgcattcgagacgatcaaggtggggtcacagaagtgggacctcagagtcgatggacagcattgccgtgcagatgggaggtggagaaactaactggggctcggtcagcagtggccacggcacaaccagtggaactcactagcaaaccgaacgccgctttctgacgccacactgggtctgatctcaacaacgaacgaccctgtctgatctacagaatgaagaacggccttcctgagtaccctgcgatcatgtgcctttcagttagggtgtactatatgccaatgctttcttacccgtgtccgtttcatcttggaagggcgtcggtccttttgatgtgcttctcgtttggtgttttaagtaagcaaagaaaataacagaagagatttaactcctgctgcgtggcttggattgtcaatctgtgtgtatatatttattattggaacagtc

SEQ ID NO: 7954 - DNA, 614 bp, Triticum aestivum
  unsure (1)...(614): unsure at all n locations
  Clone ID: LIB3281-057-P1-K1-F11
cccacgcgtccgggtttaccgagctttactttttgtcaacccaagcccatacatgggggagtgttcatgcgaggggttgggtcctggtancatctagtcctgaaattcttacaaaagtcgagaagggaaaggttattaaccggccacttgctgggactacacgaaggggcaagacagagcatgaagataaattgcaagaggaacaactattaagtgatcaaaagcaatgtgccgaacacattatgcttgtagacttgggaaggaatgatgttggcaaggtatccaaatctgggtctgtaaaggtggagaagttgatgaacatcaagcggtactcccatgtcatgcacatcagctccacggtcagtggaaagttagataatcgcctttaaagctgggatgcactgcgagcaacattgcctgttgaaacattcaagggggccccaaaagtaaaagccatggagctaatatatcagttttaagtcacaagacgaggaccatacattggtggcttaagagggatattattgtatggtgacatgcttatcggtctttctcttcggaccatttgattcttaacaacttccaaccacaatacaatttacctcatacaaaaa

SEQ ID NO: 7955 - DNA, 611 bp, Triticum aestivum
  unsure (1)...(611): unsure at all n locations
  Clone ID: LIB3281-057-P1-K1-F2
ctgtaaactgcaatgctcgcttgcaaaaacaatgtataaatacataaatacgcaatggtggggagatcataacttattgcggtggtttgactgcagctgattgttgctgtggggtcaatattaatttaactcggtgtttttgccggccattgtttggattagcagtacataaccattgtgaattacaaaaactgttctgaatttactcttccactgacctggctctgatgggaggcctcttgaccctctgctaccaggggcgaggtgtgagtgacgtanggagaagtaggtagtacggagctgcaaggtactgttactctgatcacatagctgattacttatcagtgtttatagtttataacgcaattgttcctccagttaagacttaagagtaaggaagctggtatccttggtatgtggtaagatttcttggtttgagtaaggcgtgacaataatttttatttcctttcatttctagtagctaagtaagtccacatgataatggtaggcagggaaccccagntaggtatgtattcatttcttttgacaagttgcttataagtaccaaagtacgacaatgatcatagcatagaatgattttatcagcaatg

SEQ ID NO: 7956 - DNA, 454 bp, Triticum aestivum
  Clone ID: LIB3281-057-P1-K1-F4
cccacgcgtccgctgcggggaagggaagatgttttatgagaaatggcccttcttgttgaagggtgattgttgggaaaggcggcgacattttgaggaatacataattggacctgatgatgagcttgctgatgacgggctggctccagatgaagagaagttgaagctgtacggagctgaagaaggggtatcttggatcgcccgtcctgttaggggcggcggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagcacattgtttcctaactttggcagcatgtttagcgtggcagaacagcagcaggctaaagcttactgggatgctgagagtcatacggatgat

SEQ ID NO: 7957 - DNA, 417 bp, Triticum aestivum
  Clone ID: LIB3281-057-P1-K1-F5
cccacgcgtccgcggacgcgtggggcacaacgtttcagactggtagaattgtgctctacgggattggcatcattgcctcgggattggtcaggcctgcaacggataggatctcctctccagggagagtggtgtgtgcatgcagcaggctgtgtggcgtagggtttatggttgcaaaatgtcttgatcaacaatttcaatttcagtgatcaccaagttgggctgtgatttccgggcctacattgtttgcagctttttcattcagtttattgcatgccttgccggttaatgttcctggcacctctttgggaggattgttatctgagcaatgctgttgatgcaaaatctcggcagaggcaactcctcgctaggcgtggagtcgtataagttcctcaaatgacggtactgccaatactagtt

SEQ ID NO: 7958 - DNA, 337 bp, Triticum aestivum
  unsure (1)...(337): unsure at all n locations
  Clone ID: LIB3281-057-P1-K1-F6
cctcccctgccccgggaaccggccgtcgtgctcttaccggtcccaaatccggtcgccgaggcgctctctccccgggatgcggctgccgcgccnccaccgcccccggatccggccgctgcgccacccccgtccatgaatccgaccggcgcgccgccttttcccccggatccaatctcgccgcctgtctccctgcgcgtcgtcggcgttgaccagctgagcgctgcctccacgccaagatccatgctcgaggtccaccacctgttcgcgtctgatctcccttgctcctccccccgaattcttctctgtcctctatcgccgaaagccacccactttgagc

SEQ ID NO: 7959 - DNA, 77 bp, Triticum aestivum
  unsure (1)...(77): unsure at all n locations
  Clone ID: LIB3281-057-P1-K1-F7
cggaancccggggcgggccacgcgtccggccaagcttntataaggcacggnncccgatttttttacataaccaaaaa

SEQ ID NO: 7960 - DNA, 398 bp, Triticum aestivum
  Clone ID: LIB3281-057-P1-K1-F8
gagagagagagagagagagagagagagagagggagaggggggaggtgatatcctgaccaatgccaagaacaaggggggatcattgaaaatccccggcgggcgaaaagagactagctccggcccccgtcctccaagaacaagaacaagagcaagaaggaatccgggagcacgagggaataaagcggccggaggagaccggaaaggccgaggagaaaaaagctccggcgacgatggagaaggggatggatccggcgctgctggacaacatcatcgccaggctgcttgaggtgaagagcctcaagcccgggaagaacgcccagcttttctagtctgagatcaagcagctctgcgcctcctccaaagagatctttctcgcgcaacccaaccttctggagctc

SEQ ID NO: 7961 - DNA, 246 bp, Triticum aestivum
  Clone ID: LIB3281-057-P1-K1-F9
gacggagagcgggaggggcagcaaccgccgccgccgtttacagagcacacaagatttctcacgggggacacggaggaggtgggggatgatgggaggcatgatgggcggccatggaggctatggcggcgggtacggccaccacggggggaagggcaagcacgggaagcacgggcacgggaagggcaagcacggcaagcatgggaagcacggcatgttcggcggcgggggaaagggcaagaaggggaa

SEQ ID NO: 7962 - DNA, 57 bp, Triticum aestivum
  Clone ID: LIB3281-057-P1-K1-G1
cggacgcgtgggcccacccattgccccaccatcttatttcacatctctaactcaccg

SEQ ID NO: 7963 - DNA, 554 bp, Triticum aestivum
  unsure (1)...(554): unsure at all n locations
  Clone ID: LIB3281-057-P1-K1-G10
cggcgncacgcaagcggacggagaaggcnagtttttcctctaatcccccaacccatacgggggcgcctgcgggggagccggcgggatctctcaaattcctaccgccagccgcccgtaccgacctcgatctctcctccgaggtacttagggcctaataattgggaagttggtgcaggcaatctcttgcagaacctatggacagttctaaatctccccaaccattgaagaagagccgtactagtttgtctggtacggatggccaccaatttgagaatgacgagcttcaggctgaaactgcatcagataaaacacctggtttgaagtttgaaacaggagataaagcgcaagatgaatttggagaagacagtgccccattgcagcaatcagctgcttccaatgtggcataccggggatcggcatgtattggggcatgcactatccaatgtgctaggtgcttgaaatggagactcattccaacgaaagagaagtataaagaaatacgcgagcatatgatacaggaaccttttgaactgcaaaaagcccgtgaatggaaa

SEQ ID NO: 7964 - DNA, 560 bp, Triticum aestivum
  unsure (1)...(560): unsure at all n locations
  Clone ID: LIB3281-057-P1-K1-G11
ccacgcgtccgggaattgctgaaagcagagttcgggccttttttttaactccaggaagtacatacaaacgaggataatgataggggcagcgggggttcctcaaanacctnattcatctgtcaaaccatctactccagtacgacgtatgaagcccgtcgatagtccttccacaaatttaaaaacagcagaacgcagtttcggacagcgggacatccaattattatctcgtacagggatggctattaattcttcgatcactaaaaaagctccgcctacagagtcggtagctgtaaaagatatttacactacatcacaggctgtttctgtgcctgttgttgttcctagagacattttggaggacaaatcagcaggcagtattcatagaggaattggaggcagaactgcattcccagatgatttttacagtccagtgcacttgagaaaacgtttacctagtggcggtactagtgatagtgtcagctcaataaaatccatgctcacttaacctgatgtttgctcagacggtttatctggattaaagttctcctttgaaactaact

SEQ ID NO: 7965 - DNA, 577 bp, Triticum aestivum
  Clone ID: LIB3281-057-P1-K1-G12
ttgaggataaggataaaggggattttctatctgccctcacaaagagctacaaaaacagcatctgttttcagcagcacagctataaaatacagcatctcacatgtctaaacaaatataacatcacaccaagaagaccacattttctctaacaaatgaacagaaaaaagaagactggttcttttaaagtaatcatagtgtggtatccgtgcacacaaatacatatgttctttcttctgttcccagcagaggactagctttcttcatcgacgataatagttgctcctgtgcctatcccaagctccacaagcgaagccgtctcttcttcaagtagttgtggtagtgggcatccctgctcttcttcaagaaataatctcagtttgatgtccttcagtttaaagaagctctcgcacaaagatttcagctttccaacagtagttgcaggaggcagtttctttgtcaatggttgcttctcacccatggatggccccacacatttcaaggtgatacttataagcccagaagccatcttttgtgggcctgacgtccttgaaagtggcttctcatcctcaatgccatg

SEQ ID NO: 7966 - DNA, 637 bp, Triticum aestivum
  Clone ID: LIB3281-057-P1-K1-G2
cggacgcgtgggcggacgcatgggtttttttttttttttttttttttttttttttttggggggttttttttggggtttggggggtttggggatccatatttttaattgaacaaccagaaattgaaacttatgaaacaaacggaaaaggggaacacgcttaacaaatatgaactttgaaagatcccagggccaaactaaaatgtcagggggttacagttgctactaggaaagggctgaaacataaagcatttttgggttgcttccaacactagttttatttggatgaagcaatagtgtgcaacggcgttcggggatttcatacttttttacccatgtatcccggcaaaagggcggtttaggattccttggcgtattcaaagacggcaatgaagggcatgagaacagatcctatccagaggttgccatccttttcctccatttggttaaaagttttaaccacctgccttttagtgtcctccaaaatgtcaagcacctcgccttcagggttttacttgataatgagcgcgtgcaaattgccccccttttttataagggagtgatacttgggggggattgggagggttaacaaaaatttttttgggttgggacgcgggaatttaaaaagccgggcgttttc

SEQ ID NO: 7967 - DNA, 590 bp, Triticum aestivum
  unsure (1)...(590): unsure at all n locations
  Clone ID: LIB3281-057-P1-K1-G3
accggnccgaattcccggtcgcgggcgcgtccgcggacgcgtgggcgccgagtgcctcctcgtccttttccccggccacgcatccggttccggggcgatggacgccgacgacggggccgccacgtcctccgaaccgcccacctccgaagccgacttcttcgacgtcccagatgccctccccactccccctccccctccctcaccccacaccccgtcctcctccaccctccggcgccggccgcgccgggccaaaatcctgatgcagcccgacgaccccgtctccccctcggcttccggcgcatccatcgtcaccggggtcgatgagcccgacaaggacaaggacagggccaaggccaagcctgattccgattcctccggcaccggcaccgtcaccgcgggcgatgagcccgacaagggcaaggccaagcccgattccgattccgattccgattcctgcgagggcaccagcgcgccccgttccccccctcccctcgaggaggaggtggaccataaggatgcggagccggcggcccccgaggcgaatgtggactagaaggattctgagccggcggccccccaggcgaatgtgg

SEQ ID NO: 7968 - DNA, 207 bp, Triticum aestivum
  Clone ID: LIB3281-057-P1-K1-G4
gaaaagaaacgcagccaaggggggtttttggcacgacgacggcaaaaaagggggggatcgaggggggcgggggggcatcccctacctctccggccgaggcggcggcgaggcagcgcacgtctgcacgcaccgggtggggcgggccgcgctccacacggaggaggtggagccccgccgctgcgaccgcaagtgcgagaaaaccgagca

SEQ ID NO: 7969 - DNA, 567 bp, Triticum aestivum
  unsure (1)...(567): unsure at all n locations
  Clone ID: LIB3281-057-P1-K1-G5
cggacgcgtgggctgcggcccagacttggtggtcgagcagcagcgacctcgacgcggcgcgtgcgtggtagctgatgcacgacacagcgaccgcgaccaggacgcggtggcgggagaacgacnacggctgacaagacctggcgtgacggccatgaagatatcgactccgacgactcgcctccgttcaacagcgccctgcttttccgcatcgcctccggcaagcatcaccttcttttccgcgcgcacagcacctcggtcactagtaaaccgctgtatctctgtactctggtggcgggctggatttaggagctctgggatttggagaatgcacgggctggagctggggaatagctcgggcttccttcaaaagacgataggtcgtgtttggattttttttcgaagaattaatttgatttggatgagactaatcagtacgtcatgtgggcctccaatcgaaatttgtggtgggaactttccttccattcatcttctaatcagattttgatatttgtgccattgatttgagtgctgatgaagagctttttatggacagagagtcaaacatgc

SEQ ID NO: 7970 - DNA, 651 bp, Triticum aestivum
  Clone ID: LIB3281-057-P1-K1-G6
cccacgcgtccggtttgccgtctttcagggtcttctgaaggtgcttgccggtatcgacgcgggcttcactgtcacctcaagaggctaatgacgaagaaggcgactttgctgagctctacatgttcaagtggacgacgcttctcatccctccgacgaccattttgatcattaacatggtcggtgtcgttgctggtacctcctacgccatcaacagtggttaccaatcatgggggccgctctttgggaagctcttctttgccttctgggtgattgttcacttatacccattcctcaagggtcttatgggcaggcaaaaccgcacaccgacgattgtcatcgtctgggctgtcctcctcgcttctatcttctccttgctgtgggttcgtgttgatccattcactacccgtctcgctggcccaaatatccaaacctgtggcatcaactgctaggaaagtgggagtttgtagagacagaaaatataacagtgatcgagcgaccacctgtggagccagagaatatttatgctggggttgcgaattactatgtttgagaaagttgtcaaaattgagaaaacacatttgtaaatagatgtaatagaccatctaccgttttcatgaggttaagatctttttttgggacaaaggaatctca

SEQ ID NO: 7971 - DNA, 264 bp, Triticum aestivum
  unsure (1)...(264): unsure at all n locations
  Clone ID: LIB3281-057-P1-K1-G7
cccacgcgtncgagcacacctcccaaccccaccctaatcattttttttctagcagcccttctacatcccgcgctattaattgagagggggagcctacgaccgacaccctcaccatattcccattttccatagtccacatctcaccaatttccacataaactaccaccgtttcatttgcatctaccgacatgcacatggtgacaactccacctcttcattccagctagccacccaatgcaaaggccgaaatctcaaattttttca

SEQ ID NO: 7972 - DNA, 311 bp, Triticum aestivum
  unsure (1)...(311): unsure at all n locations
  Clone ID: LIB3281-057-P1-K1-G8
cggaaaacccgggggcgggccacgcgnncgcccacgcgnccgcggacgcgnggaccggattttttctacaaaccaagcgagaaagggggggggaatgagggagggaggggggggcaaaagccgnaacaaccnccnnagctaacnccaaagacanataaagagaagcaggcactggcggggcgacagaaggacaaacaagctgtcatgcgagggcaaagacctgatggagaaactctacagggggaattcgcgccaacggaggccactgaagcactatatgagtatagcggcggaagcataaaagcaaacag

SEQ ID NO: 7973 - DNA, 550 bp, Triticum aestivum
  unsure (1)...(550): unsure at all n locations
  Clone ID: LIB3281-057-P1-K1-H1
gcgaattcaatggcctggttgatgtctaccgcaagactctcaagtcagatggtattgctgggggtgaccntggattcaacatgtggtgtnnttaaatcattgtctaccgtggtctgtactttggactgtgatgattctctgaagcccggtctcctcactggcactctccaggacaacttctttgccagctttgctcttggttggttgatcaccaacggtgccggtcttgcatcttaccccattgacaccgtccgcagaaggatgatgatgacctccggagaggctgtcaagtacaagagctccttggatgctttccagcagatcctggcgaaggagggtgccaagtctctcttcaagggtgctggtgccaacatcctccgtgccattgctggtgctggtgtgctctccggctacgatcagctccagatcctcttcttcggcaagaagtacgggtcaagcggtgcctagaggggaagaaatgatgaccaacaagagaagtctggtcccagtcctgcccttcaaggatctggcgaacttttatctttttaac

SEQ ID NO: 7974 - DNA, 329 bp, Triticum aestivum
  Clone ID: LIB3281-057-P1-K1-H10
ccacgcgtccgcccccgcttcacttaaaaacacccgagctttttcttcgatctcccataccattcccccgccacttttcgcgatggccggggcgaagtatactgtccgcaagtccaccggcggcaatgccccgttgaagcagctgacaaccaaggcggcgcgcaagtcagcccctgctaccggcggtgtgaaaaaacctcaccgcttccgcccgatcaccgtggcgctgctctagatccgcaagtaccagaagagcacggagctgctcatcctcaagctgcccttccaccgcctggtcctctagatctctcatgacttcaagaccgacc

SEQ ID NO: 7975 - DNA, 608 bp, Triticum aestivum
  Clone ID: LIB3281-057-P1-K1-H11
gcagcggcggccgtctccaggatcaagaactttaaattttttcccctcctcttttctgggcgccggttcttgtgtgcgcggggccgctcacccgagaagaagggagggctcttgctgccgcttcgtccttgcatttgtgtgagagcgcttgtgagcgggggaggccatggcggatccggacgccgacgagagcccggacttgtggcagctcttctgccactacgaccggctctacttccgcggcgagctcgacgccgccgccttcgccgtcgagtgggcctacccgcgcatgaggacgaccacttgtttcggatcctgttcctttggagaccttaacaaaataatactctatgagccaatgctgcaatggcgcacaaatgctgatatgaagaatgccctgctgcatctgatgattcatgcaatcatatttgtaaagcatggtatgaagaacctcggccatggtcctgttttccgtgattggatggatgctatcaacacttgcactgctgaggatctcatgagaccgacgggtggctaaccgatcaccactacccatgatttcagtgaggaaaaatcctccacatccacgggattccatggaagtgtga

SEQ ID NO: 7976 - DNA, 275 bp, Triticum aestivum
  Clone ID: LIB3281-057-P1-K1-H12
gaaacattcatccttttctaccggggttgccagagtacatagggggaaaagatagctcgcggcttcgtaattagtagcgctcgtaaataatatcaataataatacaattacaacgtataactgtctgatcagactacaagctaaaaacaaaacttgcagggcctagtggtgcttgttcagatcaattctttagtagtttcctcaacacgtttgcaacataacgctccatctttgggaaagcccatgcatgctggataatgtcgaggctgtctttc

SEQ ID NO: 7977 - DNA, 581 bp, Triticum aestivum
  unsure (1)...(581): unsure at all n locations
  Clone ID: LIB3281-057-P1-K1-H3
gcgtccgcccacgcgtcctagcaaaagcagtancaacaatgttttagacgtaacggcgtcaacgcgagcggtgttcttggcctggctggtgggcaccaccgttgcttgccatggtgcaagggacatcccagcaactgagcccgagtcctaccgtccccagaacgtctttgggttcggtggtttctaccctggcccgtcggtcaactgggtgtttccggggccaaacggcgtcacgccacaggtaggcttcggcgggatgctgggctctagctccttccctggcactggtggctcgtccggcagcagtggcgtggtcggcattcatggtgctgccaatccctgatcgtgttggtgtctgtcttggtgtcttgatgtttaagcttttgctcttgagagctacgcaggtgcagcattctaccgtggtggtagagagtaagcttcttgcttgctctagtttagcagtattgtgttatggcttatgtgttgtgtgttgttttcaagtgatctgtgtcccgtgtctttgtaaaagacttgttcttggttgttatttaaccttgtgtacttcttaaaggttgaattgc

SEQ ID NO: 7978 - DNA, 525 bp, Triticum aestivum
  unsure (1)...(525): unsure at all n locations
  Clone ID: LIB3281-057-P1-K1-H5
cggacgcgtgggcggacgcgtgggctcaaacttataaccctagagccgctcccctcctcggcggcnaagcgctcgccacccgagtcgccagtccccaatccctccagggaggcgcttccgcgaaggtccgctgctgcggtcatggctcgcgtctacgtggggaatctggatccgcgcgccactgcgcgcgagatcgaggacgagttccgcgtgtttggggttctcaagagtgtgtgggttgctagaaagccaccaggatttgctttcattgactttgatgagaccagggacgcaaaggatgcaattcgtgaattggatggtaagaatgggtggagagttgagctgtcaaccaaatctagtagtggccgtggccgagaacgtgaacgctctggaggttctgatatgaagtgctatgagtgtggtgaaagtggtcactttgcacgagaatgtcgcctacagattggttctgggggcctgggtagcggaagactccccaacccaagcccgaggcaccgcagccgaagc

SEQ ID NO: 7979 - DNA, 603 bp, Triticum aestivum
  Clone ID: LIB3281-057-P1-K1-H6
cggcaatcccctgcgatttactgccgcttcaagttcaactcctcagattcgcagcttcgggggagcggattgctgcgcagagggggtccggatctttcctcaaggtgctcgtcagcaacctggacgttctcgccgggcccatagtttcactcgcttatcctctgtatgcgtctgttcgagcaatagaaacaaaatctcctattgatgatcagcaatggctcacttactgggtgctgtactcgtttatcactctgtttgagctcacttttgctgcagtaattgaatggctccctttctggtcttatggaaagctgtttttcaattgctggttggtcttgccctactttaacggtgctgcgcatgtttatgagcattttgtgcggccaatgattgtgaaccagcaggttgtaaacatctggtatcttccaaaaaaggaaggttcagacaaacctgacgatgtaatttcagctgcacagaaatacattgaacaaaatggatcaaaagcatttgagactctcgttaacaagtttaagactacaaacgcgaggcgctcatatttggaggaggtagaggcggaaaggagagccagggctgaacgagagc

SEQ ID NO: 7980 - DNA, 580 bp, Triticum aestivum
  Clone ID: LIB3281-057-P1-K1-H7
agcgcgaccgaaaataccactcgccccttcgccaccggacgcggtcggagatggcggggaggacagcgcaggcgccctgggcgcttccgccggccggcgaggtgatcgaggtggagaactcggagccgggctcgccggacgtcggcagccgaagcagcggcagcggccggagctcgtcggagtactccgggtgggtctaccacctcggcgtcaactccatcggccacgagtactgccacctccgcttcctcgtcatccgcggcaagtgcgtcgccatgtacaagcgcgacccgcacgacaacccgggactcgaacctatccgaaaagggtttgtcagtcacactcttgtggtggaggaggttggtcgcaaaaaggtcaaccacggggatgtttatgtcttgaggttgtacagtagattggatcaaacgaagaaaggagagattgcgtgtgcaactcctggtgaagctcagaaatggactgaagcatttgaacaggctaaacaacaggctgagtatgacctgacaagaggggctaactggaacagattgcagagtgaaaacgaggttaatctcgatgggca

SEQ ID NO: 7981 - DNA, 179 bp, Triticum aestivum
  Clone ID: LIB3281-057-P1-K1-H8
cgcaggccgaggctgctgccgcaacgggccattcggcgatcccggcgtcgagcaaggggggccgtttccccgtccgccgaggcaaggccagcgccggcaccaggtgcctggtcaaggccaaccatttaatcgcccagttgccggacaaggacctcaaccactaccatgtgtccatcacc

SEQ ID NO: 7982 - DNA, 525 bp, Triticum aestivum
  Clone ID: LIB3281-057-P1-K1-H9
cgcctcgctcgctcagtcctccggctgccgccaacgccgccgttctgcacgagcgaagacgatggctagcggggagaaggtggactatgtgtttaaagtggtgctgatcggggactcggccgtcggcaagtcgcagatcctggcgcggttcgcgcgcaacgagttcagcctcgactccaaggccaccatcggtgtcgagttccagacgcgcacgctcgtcatcgaccacaagtccgtcaaggcccagatctgggacaccgccggccaggagaggtacagagctgtcacgagcgcatattacagaggcgctttgggagctctgctagtctatgacatcaccaagcgccagagctttgaccacatacctcgctggctggaggaactccggggtcatgcagacaaaaacattgtcatcatgctggttggcaataagagcgaccttgaagatgagcgggctgttagcactgaggatgccaaagagtttgctgagaaggagaacctctttttcctggagacgtccgcgct

SEQ ID NO: 7983 - DNA, 342 bp, Triticum aestivum
  Clone ID: LIB3281-058-P1-K1-A1
cccacgcgtccgcccacgcgtccgcggacgcgtgggcgaagggcgaccactcccgccgccaggccgaagcactaccgccccgggggcaagaagaaggaggggaacgccgtcaagtacatcaccaggaccaaggcggtcaagtacctgcagatcagcctcgccgtcttcaagaaactatgcattctcaggggagtgttcccaaggaggccaaaaaggaaggggggggggaccaccagacctattaccacattgaggacctcggctttcctggccatggccccttggttgaaaaggtcaaaggaatcaaaggtcacaaaaaggaaggtaaaaaggctatggctt

SEQ ID NO: 7984 - DNA, 66 bp, Triticum aestivum
  Clone ID: LIB3281-058-P1-K1-A10
cggacgcgtggggtctgctgctatcttaccgtttgaatgagatgaactccgctatgaatgatccgt

SEQ ID NO: 7985 - DNA, 444 bp, Triticum aestivum
  Clone ID: LIB3281-058-P1-K1-A11
cttttgtaaatcaggttgttgaagttcccaatgtctcttgggaagatattggtggtctggagaatgtcaagcgggagttgcaggagactgtccaataccctgtggagcatccagagaaattcgagaagtttggcatgtctccttccaaaggtgttcttttctatggccctcctggctgtggtaaaaccttgttggccaaggcaattgcaaatgagtgccaggcgaacttcatcagtatcaagggacctgagctgcttaccatgtggtttggtgagagtgaggctaatgtgcgtgagatctttgacaaggctagggggtcagcaccatgtgtcctcttctttgatgagcttgactccattgctacccagagaggaagcagtgttggggatgctggaggtgcaactgatagagtgctgaaccagcttctgactgagatggatggca

SEQ ID NO: 7986 - DNA, 458 bp, Triticum aestivum
  Clone ID: LIB3281-058-P1-K1-A12
gtcttcttcttcgcctgatctcctcccgatccttctccaaatcagagacgtgatctcgagttccaccgctaaatcggcgatcaggtggcccgtgagagttgatacttctctcttgctctgctgtgttgcaggtagcgggtcgaaggcttcatcaactgaaacaaatggtctggaggaactcccagaggtttcggcgttcctggagaagctattccagcctcatactcagtgagcgtacacttggtttggacagaaaaactgaggaatggaaaacccatctcattgacaaagttgacaaaattcttacaaaccattatcacaatggggtgaaggtgaagacacttaaacttgatattggcccttgcagagatatcaaagcctcctacctcgacaggtggctccgaatcattaaacctgggatccaagaatttaacttgctgttgcctttagtcgtcaat

SEQ ID NO: 7987 - DNA, 459 bp, Triticum aestivum
  Clone ID: LIB3281-058-P1-K1-A4
gctccttatggcgcctactctccagctagttccccagtcccaacagttgatggtcagatggttgctgcacaacattaccagtgtccagcttattatcagcctcctaccccgatttcttctacaactcaaggtgaccagcagcattcagccaatgctgataataagccagcagctaaggcagatgctgccaaaacaaccacaaatgttgttcctaatggtactgctcagagtaacagcggaactgctccccttgggtcaagctaccagaattcatcactgacccctgatggaacctatagggcacccttgataggtggagtcccttctactggttacgtggactcaacctatgggtatgacaccacaggggcacactatgcttggtatgatggttctgcctataccaatgcacagcatagaccaactacagctaattacacgccgtcttcagcgtataat

SEQ ID NO: 7988 - DNA, 464 bp, Triticum aestivum
  Clone ID: LIB3281-058-P1-K1-A6
cggacgcgtgggcggacacgtggggcgaaaggtaatcccaatccccacagaaatccccatgtcaaaaccctagccctcatccgcgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggtgcaacggcaccggcggcgagtccatctacggcgagaagttcgccgacgagaagttcgtccacaagcacaccaagcccgggatcctctccatggccaacgcggggcccaacaccaacggctcccagttcttcatct

SEQ ID NO: 7989 - DNA, 299 bp, Triticum aestivum
  Clone ID: LIB3281-058-P1-K1-A7
gaacggcctggtgatcgcattgaactcacatttcactgttgtttggaaggcagcggttggtgctcctatttttggtggtgcatgtatttcatatgcccttccttctcaggtcctgataccttcccgtgatggaagtttatactcctttgatattacatctggtgatcttctttggtcatatgacgtcggcaacccaattcctgcatctgcttttgttgatgaagtgttagcatcaaggccatctggagcatcaaatagatttgcttgtatctgcacaagttctgggaaggtccgtatcc

SEQ ID NO: 7990 - DNA, 413 bp, Triticum aestivum
  Clone ID: LIB3281-058-P1-K1-A9
gctggaaaatgggggaagtggaggacgtcagtaacaggatggaggcgcatctgcgcgtccgacgcggctgaggacgacgccggtctcccgctccccgccctcttcgacagggcgtcccacctccactcgctcgcctccagctcctccctcgaccaggaagggatcccgaagggggtcgacctgctgcggcgctgcgacgacatggtcagcaagctcgggctcttctcttccaacgaggaccaagggagacctcttcaccggcaatctcaagtacctggtcgtgccgtactaccttggggaaatgactgagcaagtggagcaggaggaccggattccggtcctcaaggcatcgcaggaccatttgaaagagttcatttctggatgtgaagcattggagcttattccagaggacg

SEQ ID NO: 7991 - DNA, 414 bp, Triticum aestivum
  Clone ID: LIB3281-058-P1-K1-B11
gctcgctcgcgttccgagaataaacttcgccaataaacaagcgcgcccattctctggcccttgggcgtctggatccgagagccggccgccaacagcaatggcgtccctcctggagatcttcgtgggatcctgttcctcctcggcgccgccggtggactgggaggcggaggcctacccggagtacgccgactacgccgtcctccccctgctcctcgccttcttccccgccctgcgccttctactcaaccagttcctcttcgaggtgttagcaagacgacttatatttggaaagggatatgacaagcttgttgaaacagatgaaaggagaaagaaaatcaataaatttaaaggaatcggcatgggaaattgtttattatctttctgcagaactcttttcactatctgtaacataca

SEQ ID NO: 7992 - DNA, 177 bp, Triticum aestivum
  Clone ID: LIB3281-058-P1-K1-B12
cccacgcgtccggttagattgatatatatactcatgctgatatcatttgatatgcgtcgtgtcttggcttgttgtgagtctggaaagaagtatcaggcttgttttatgattagaatattgaagtattattggtccttagcatcttcttttttgtaaatttaattttgatgccctgtt

SEQ ID NO: 7993 - DNA, 455 bp, Triticum aestivum
  unsure (1)...(455): unsure at all n locations
  Clone ID: LIB3281-058-P1-K1-B3
gctcgttttgatgatggagctgggggcgataactaagtacagcgtactatgcttgaaatcggcaatcatcttgatggttttggtgctagggataatatcaaggttctcatggccaccaacaggcctgatacacttgatcctgcacttctgcgtcctggtcgtttggacagaaaggtggaatttgggttacctgacttggaaggccgtacccagatattcaaaatacatacgcgcaccatgaactgtgagcgtgatatacgcttcgagctactggcgcgactctgccccaacgccactggcgccgacatcaggagtgtctgcacagaagctggcatgtacgccatccgcgcccgcaggaagactgtgactgaaaaggatttcctcgactcggtcaacaaggtcatcaaggggtaccagaaattcatcgcaaccncaaaatacatggtgtacaattg

SEQ ID NO: 7994 - DNA, 463 bp, Triticum aestivum
  Clone ID: LIB3281-058-P1-K1-B5
ggaggtggcagcggcggcggcgggtccggcggtggcggatcgggaggaggcggatcaggcgggcgcgcgcggtgccccatcgacacgctgaagctgggggtgtgcgccaacgtgctcaacgggctgatcaacctgcagctggggacgccgccgaagcagccgtgctgctcgctaatccaggggctcgccgacctggaggcggcggtgtgcctctgcacggcgctcaaggccaacatcctgggcatcaacctcaacgtgcccatcgacctcagcctcctcgtcaactactgcggcaagaacgtcccctccggcttccagtgcccccgctagaagagaagacccgagagatccatcgtccactgcatgcaggcatccactatacgtacgtacgtgcatgcacgcacgcatgatctacaatccatccattgactagtgctctatagctagtcgtatacgttatttg

SEQ ID NO: 7995 - DNA, 446 bp, Triticum aestivum
  Clone ID: LIB3281-058-P1-K1-B6
cacagatttaacaatctagagttagcgcctccgtccgtctcgtagctgctcagatggcgagcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttggtgctcctgctcgtgttgggctaagtgcaccttgtgatgtggtggttccccctggcaacact

SEQ ID NO: 7996 - DNA, 338 bp, Triticum aestivum
  Clone ID: LIB3281-058-P1-K1-B7
gtctcctcctcctttccccaacccataccaggtgcgccctctctcccccgccccctccccgcaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaa

SEQ ID NO: 7997 - DNA, 426 bp, Triticum aestivum
  unsure (1)...(426): unsure at all n locations
  Clone ID: LIB3281-058-P1-K1-B9
cggacgcgtggggcggttgcatccacccgtcatccaagccaagccaagcatggcggcggaccacggctccaagggcggcatgtgcttcgccggccgcttcaccgccagcgccatcgccgcctgcttcgccgagatcaccacgatccccctcgacacggccaaggtcaggctgcagctgcagaagaaggccgtcgccggggatctcgctgggcccaagtaccgtggcctgctcggcaccgccgccaccatcgccaaggaggaaggcgccgccgcgctctggaagggcatcgtccctggcctccaccgccagtgcatctacggcggtctccgcattggtctctatgagccagtcaaatccttctatgttggtgagaaccatgttgnggatgtacctttgtccaagaagatagccgctggcttaccact

SEQ ID NO: 7998 - DNA, 463 bp, Triticum aestivum
  Clone ID: LIB3281-058-P1-K1-C1
cttcaacaccccttttagttgtcgtccctggattaaccagtgattctgatgctgcttatgcaaaacacttggttcattccatggcaagaaaagggtggaatgttgttgtaagtaaccacaggggtcttggtggtgtgtccattacatcagattgcctctacaatggtggatggacagaggatgtccgagaagttattaattatctccatcgcaagtatccaaaggctccgatgttctgtgttggtacaagcataggtgccaatatcctggtcaagtaccttggagaagaaggtgagagtactcctctggctggtgctgcatctatttgttctccatgggatctggtggtatgtgacagatttatttcccgtaagcttgtgcaacggttttatgacaaagcccttgcgtttggtctaaagggctatgcaaagctacatcaacctgtcttggctcgccttgcaaa

SEQ ID NO: 7999 - DNA, 391 bp, Triticum aestivum
  unsure (1)...(391): unsure at all n locations
  Clone ID: LIB3281-058-P1-K1-C11
acgcccacgcgtccgctccctcctcctacattctttttagcagccgccgccattctggcgcccgcctctctggcctacggcgatgctgccggnaggaagctattgttcgtggtgccataccgcagccggtgtgctgcacaagaggccaggggccgccgccaccgcgagccatgggacgcccgtcgatgagccttcgggcaggaagcccgcatcgagcacgccatcaacaagccgccaggacgacctactggccggtcccgcgtcgtctagcaagggccctggttgcaccgtcgtggaggaggcgcaccattaaggagtagcaatgccgtcgaactccctcttcccttctgtctgcacctttcctatgagcttttcttccattcccttgctt

SEQ ID NO: 8000 - DNA, 430 bp, Triticum aestivum
  Clone ID: LIB3281-058-P1-K1-C12
agtcgtatatctctcgctcacagtttacattagcctcgatgggcttatatcgagggagtacagagggagagagagagagtacaacggcacccatggcatgcagggcgtgcgggcgcacgtaggcgcatgaagtgcgtggacagtttggcctagctagagacccggcgaagtgggttagccacctgggagctgctgtagacgtgcggtcgaacagtacccgcgtcttatggtcctttcaggtttggtggctcagtgctctgctgacttgattgatcttccattgcttcctcgcattccttcagaaatctctcaacaccaggatcataagcagtagccgcccgcaggtatttcgcagcctcaaatttccgaccttcatttgacagtatactttctagagcaataaaaccctggaaatagcatgccttggtca

SEQ ID NO: 8001 - DNA, 414 bp, Triticum aestivum
  Clone ID: LIB3281-058-P1-K1-C4
cggacgcgtgggtgctctcgcagttattcaggttatgcttgattttcaagcagctgatagggaaagccttgaggagccagctgctgatgtcggtctggaaactctgtgcgcattgattaacaacaacctgcgttgctacgaactttcatcagagctaagtagcagcacattggaagcgcttcctccgaactatgctgaacaggttaattttgaagacacttgcaaaggatttcttgaggttgccaaggaggcggtccttcaaactgtcagtgttattttcgaagacccaggtgtgcaggatcttcttgcgaaggtttaccaaaaagactggatggatggaatggtgaccgaatatctggtcgccacgtttgctgattattttggcgatgtgaaactatatattgaaaatagatc

SEQ ID NO: 8002 - DNA, 459 bp, Triticum aestivum
  Clone ID: LIB3281-058-P1-K1-C5
ggaaccctagccgccgccctctcccactcatcctcctccccgctccccttcctagcggctggcccgaccgccacgcgacgtgggctcctccccaccgtcgaactcaagccgccgctcatcccccgtccccatcgcacctcccctgaagccgccggctggcgctctcccttcaccggaggagttgggtgagaggagcgtgggccgtcgccgtcctcgtgcaccccatgtcgctgccgtcgcctccgcccagtcgggcgccgctcctctgcgccgctttcctcctcctcctcctcgaggccggccaggttcaagcgtgggccgcgtagatagcaaagtggagagctatccgcggcataatcgtgggcgggatgagcgaggaggtctagccatctgcggcgccgtccctgccgtgcctcaatccaggacgagaagctcgtcctcctgctccaccatatgccc

SEQ ID NO: 8003 - DNA, 452 bp, Triticum aestivum
  Clone ID: LIB3281-058-P1-K1-C8
cggacgcgtgggctgtgtcccattgatatctttgtcagtacagtggatccactgaaggaacctccactgatcacaggagatgctgtcctgtccattcttgctgtggattaccctgtcgacaaagtgtcatgctatgtttctgatgatggttcggctatgttgacgtttgagtcactctccgaaactgcagaatttgctaggaagtgggttccattttgcaagaagcacaacattgaaccaagggccccagagttttactttcagcaaaaaatagattacctcaaggacaagatccagccttcttttgtgaaggaaagacgagcaatgaagagagagtatgaagaatttaagatacgaatcaatgcacttgttgccaaagcccaaaaagtgcctgaagaggggtggaccatggctgatggcaccgcttggcctgtgaataacccgagggacca

SEQ ID NO: 8004 - DNA, 458 bp, Triticum aestivum
  Clone ID: LIB3281-058-P1-K1-C9
ctcgccgtctcgccgccgtcaccaccgtagcttgataagagaaaaaaagagagaggggaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttcttctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtc

SEQ ID NO: 8005 - DNA, 458 bp, Triticum aestivum
  Clone ID: LIB3281-058-P1-K1-D1
cggacgcgtgggccaaaccctaccccgccgccgccgtctccgacgcatcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgact

SEQ ID NO: 8006 - DNA, 353 bp, Triticum aestivum
  Clone ID: LIB3281-058-P1-K1-D10
tcctcctcccactcccactccgcttccccttcttcttccgccgtccggcggactggtcctgtccgtctcgtgttggggcatgagatccggctctgactgcgacctgattctccttcttattctccccccctataaatctaaacaaataccctgtgtgaaagatccagatccaccatgtcgctcaaaggctaccacgaagcctcactgcatccgccggctgcgtatgatgcggcggcggcggcgactgtgtgggactggggggaagccctcctcgacaagttcgcctacatggtccacatgaaagaccaccaaataaaccatactttcgcccgctgtacattcaagaggtattt

SEQ ID NO: 8007 - DNA, 418 bp, Triticum aestivum
  Clone ID: LIB3281-058-P1-K1-D12
aaaaatctctctccgctccccgctccgagtcgcgtcgcgtgaggagaaaggaagggaagccagaaagggttctcgccgaggcggaaggaggagatggccgggaagggaggcaagggcctgctcgcggccaagacgacggccgccaagaccgccgagaaggacaaggggaagaaggcccccatctcccgctcgtcccgcgcggggctgcagttccctgtgggccgtatccatcgtcagctgaagcaaaggactcaggccaatggccgtgttggtgctactgcggcggtctactctgctgctatcctggagtacctgacagctgaggttctggagctggctgggaacgccagcaaggatctcaaggtcaagcgtatcacccctcgtcacctccaactggccatccgtggagacgaggagc

SEQ ID NO: 8008 - DNA, 462 bp, Triticum aestivum
  Clone ID: LIB3281-058-P1-K1-D5
cactggttaatgacacagtcggcacattggctggtgggagatatatggataatgatgtgggtgctgctgtaatattgggcactggtacaaacgcagcatatgttgagcatgctaatgcaattcctaagtggactggactactgccaaaatccggaaatatggtaatcaacacggaatggggaagctttaaatcggacaagcttccactttcagaatacgacaaagcattggactttgaaagtttgaaccctggagaacagatctatgaaaagttgatttccggcatgtatcttggagagattgtgcgaagaatcttactgaaactggctcatgatgctgcattgtttgggggatttgttccagctaagctggaactgccattcgtacttaggaacccaaatatgttcgccatgcaccacgatgcatcacatgacccttaaaattttgggaagcaagctaaag

SEQ ID NO: 8009 - DNA, 448 bp, Triticum aestivum
  Clone ID: LIB3281-058-P1-K1-D6
cggacgcgtgggcagcgcgggaccgcgctccctcgacctcgaggatctcgaatcccgggagaaccatccctgcgccgagctctgatgcggcaacaagtggccggcttgattcgattcgactggctgtttgttttacccgccaccactgcctctgcagctcagctcctcggttgttttcttgacgctgccgacgggcggaccgaccgttcatccacccccacctcggggcttaccgtccccccgctgtcgcgtttagattaatcaatgcgggcggggctaatggcgtgcgccagtggacactgactgaccttcgcaccacacccacatggcccgtcgtgggagggaaggtgaccaggtgaggtgagcagcgcaaaggttcgtgcgttctagaccgccaagggcaacccggcaagaacgagggctcctttctgttccctcctgcatgcac

SEQ ID NO: 8010 - DNA, 422 bp, Triticum aestivum
  Clone ID: LIB3281-058-P1-K1-D7
gttgcacaagaattcctcccacccccaccgtctcgccgccgccaccacagctagagtaagaaaaaaagagagagcagggctcggtgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccacttcccgtagctcaggatttttatgcaattttattctgactctttt

SEQ ID NO: 8011 - DNA, 461 bp, Triticum aestivum
  Clone ID: LIB3281-058-P1-K1-D8
cggacgcgtgggctctcccccgatccactcccgttgccgccgtcgccccatgccaggcgggggaacgaagagacagggcccggcgtggctgtcttgctcgccggcgcgcgcgtgcgtgcttcgatgcacggcgctccatcctgccgattccccatcgtctcccactgccgccaaccacatcttcgcctttgttctcccatagcacgccgccgagcttcccgctcccctcctcgcagctccacaactgccagatctgccgctctccgacccctacgtcctcgaggtcgactagatccgcccctcccgctatctgaagctcgccgcgaccccttgctcgtggctagggtttcggctgcggtgctgcgtccatcgacggtgcgtctcaggcggcacctttccgtcgcccaccccgggctccgcgcaagttcatccgctccggtacctcgaggagttcgcgcggg

SEQ ID NO: 8012 - DNA, 460 bp, Triticum aestivum
  Clone ID: LIB3281-058-P1-K1-E1
gaatcccccaggaaagccagcgaccccccctccttccttccccgcaaccaccgtccaccgggcccccggcgcccggcaccggggaagcggcggcggctaatatgagggagatcctgcacatccagggcgggcagtgcgggaaccagatcggggccaagttctgggaggtgatctgcgacgagcacgggatcgacgggacggggcggtacgcgggggactcggacctgcagctggagcggatcaacgtctactacaacgaggcgagcgggggacggttcgtgccccgcgccgtgctcatggacctcgagcccggcaccatggactcggtgcgctccggccccttcggccagatcttccgccccgacaacttcgtcttctgccagtccggcgccggcaacatctgggccaagggccactacaccgagggcgccgagctcatcgactccgtcctcgacgtcgt

SEQ ID NO: 8013 - DNA, 421 bp, Triticum aestivum
  Clone ID: LIB3281-058-P1-K1-E10
caactctccaagtccaaccccacgaccatggcgaccaagcagagcctcctcgccggcgcagccgtctgtctcctccggctggcggcggcctacgccttcaccgatgtcgagtactgcaataagggcaaaaactacccggtgaaggtgagcggcgtggagatcgtgcctgatcctgtcgagcgcggcgtgccggccaccttcaagatctccgctacaactgataaaaacatcaccgaggggaagctggttattgatgttaaatattggatcttcaatgtttactctgaaacagatgacatctgtacgaagacccaatgcccggcaacttctaatttcgagctatctcactcgcaaaccttaccatcaatcactccaccaggttcttacaccattcagatgaagatgctcggaaagcacgatg

SEQ ID NO: 8014 - DNA, 384 bp, Triticum aestivum
  Clone ID: LIB3281-058-P1-K1-E11
cccactcgtacgcccacgcgtccgatttgcttctggcagtttgacatgcttgatgggctgattgctggcgagtcagggggctggtgtgctgatggttgcactgcaattgtcgactcaaggacctcactgctcgctggcccaacgaccatagtggctcaagtcaatcatgcaattggggctgaggggattatcagtacagaatgcaaggaagtagtgagagagtatggagagatgatccttgagttgcttgtagcacagacaaggccacagaaagtgtgcagtcagattggtctctgtgtattcgatggtcgttactctgtcagtaaccaaattgaatctgttgttgattagaaaagagaaacgagggttctgatcttcttttgc

SEQ ID NO: 8015 - DNA, 414 bp, Triticum aestivum
  Clone ID: LIB3281-058-P1-K1-E12
cggacgcgtgggagaacccccaagaccggtctcactcgccccctcggacctgctagggatggcacgcgccgctgccgccaacgctgcgtggcctggtcggcattgcagcggcgggccggaggcgggtgaccgcctccgtcgcgccaccccgcgcgtcgcccggcgggcgcgcattccgggccgtggcctcaggctccgggggcaggacgactcctgaatcctcctcttcgtcctcgccggccctaccacagctgcagccgcggcgcggcttggcgacgagacgagcggtgctgcgtaacttgattagcggcggcttagagagtgaggatggtaagctgagctgcggatattcaagttttaaagggaggagacctactatggaggatcgctacgatgtaaagttcgctaaaatga

SEQ ID NO: 8016 - DNA, 407 bp, Triticum aestivum
  Clone ID: LIB3281-058-P1-K1-E2
cccacgcgtccgccttaagaaggtctctagttcgggtgttgttaccaatcttctttcttgggccgagttcaaactaaacaaggaacttaaaaagactgatggaaccaagaagacaagtattgttggcatccctaagctggaggatgcaaatgacgctggtgggaagaactctgacaagtgcaccttgatccttactgaaggagattcagcaaaggctctagctatggctggcataggtgtagtaggaagggaccactatggcgtgtttcctctcaggggtaaattattaaatgtgagggaagcgagccataagcaattaatggagaatgcagagatccaaaatataaagaaaatattaggtctgcagcatgaaaaaaagtttgatagcacgaaaggcttgagatatg

SEQ ID NO: 8017 - DNA, 460 bp, Triticum aestivum
  Clone ID: LIB3281-058-P1-K1-E4
gaaacttgctaagtcttccaaagactacgatgttgccattgagactttccagaaggctctgactgagcatagaaacccagatgccctgaaaagactaaatgatgctgaacgagcaaagaaggagctcgagcaacaagagtactatgatccaaaactagctgacgaggagcgagagaaaggtaatgagttctttaagcagcaaaaatacccagaagcagtgaagcattacactgaagcgctcaggagaaacccgaaggatccgaaggtttacagcaacagggctgcctgttacaccaagctgggtgccatgcctgaaggtctcaaggatgccgagaagtgcatcgagctagatcctacattctccaagggatacaccaggaagggcgcgatccagtttttcatgaaagaatacgacaaagcgatggaaacttatcaggaaggcctaaagcatgatccgagt

SEQ ID NO: 8018 - DNA, 451 bp, Triticum aestivum
  Clone ID: LIB3281-058-P1-K1-E5
caaacgccggctcgctctcgctccgtctcccttcctcctcccccgctccgcgccctccggcggcagatcccgtcgagcccccggcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtcttcgtcgatcttgagcccaccgtgattgacgaggtccgcaccagcgcctaccgccagctcttccaccccgagcagctcatcagcggcaaggaggacgccgccaacaacttcgcccgtggtcactacacaattggcaaggagattgtggatctc

SEQ ID NO: 8019 - DNA, 452 bp, Triticum aestivum
  unsure (1)...(452): unsure at all n locations
  Clone ID: LIB3281-058-P1-K1-E6
cggacgcgtgggttccaatccgacgatctcgatccgcccacatcccgatcgatcccaaccgaagcggtagcagccggccaatcaaccaatcgcgatggccgtcgacgaggccaaggcgaagggcaacgcggcgttctcggcgggccgcttcgaggaggcggcgggccacttcggcgacgccgtcgcgctcgcccccgacaaccacgtcctcttctccaaccgctcggcgggctacgcctcgctccaccgctacaaggaggcgctcgccgacgccgagcggaccgtcgcgctcaggcccgactgggccaagggctactcccgcctcggcgccgcgcgcctcgggtccggggacgccgcgggcgccgtcgaggcctacgagaagggcctngccctcgacccctacaacgccgtcctcaaggacgggctcgcccaggcccgtttggtccttcccc

SEQ ID NO: 8020 - DNA, 447 bp, Triticum aestivum
  Clone ID: LIB3281-058-P1-K1-E7
acaccctctgtcaactccaatgcgactttgtttatctcaacttcaaaacatgttcaggtcagaacttgacatggagggtgtactgatgatacccagccgaatgaagctctaagctatctcctcagttctcaggttagaaaacgattagttccatgtgtatttaacagcatgtccatgtatatttaacaccaagtccatgtattactacatgagaagtactgctagtgagacttcactactccattccaacaaacgtgtatatgcaatcctggtttgacaaagtactctgctactgctggtttcagttccctcactggatttgcaggctcacgaccatcctctaacaccccgtcagtgccaccgatttgaaggagctccatgactagtatctctgagttctaatgctcctaacgatcgtgtggaatcttatattcaatatcttgctga

SEQ ID NO: 8021 - DNA, 423 bp, Triticum aestivum
  Clone ID: LIB3281-058-P1-K1-E9
tccaaacgccacagcgcagcagcagccagatccccagcccctccatcccaatggcggggacgaagcatacggcccggaggtggaccggctgcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcgtacctcgtcgggctcttcgaggacaccaacctgtgcgccatccacgccaagcgcgtcaccatcatgcccaaggaca

SEQ ID NO: 8022 - DNA, 452 bp, Triticum aestivum
  Clone ID: LIB3281-058-P1-K1-F1
cggacgcgtgggcggacgcgtgggccggccgcctgccgcccctccaagtactcggacttctgcaagaacgagtgcccgcagggcttcacctacgcgcatgacagcccctcgctcacccaccagtgctccgcgccgcgcgagctcaaggtcatcttctgccactagactagaggtagtccagcggcgctcgcggtgccgccgccggccgtcagcagctatgtctgggtctgggatcgatgtggtgtagtgcgtgtcatctcatctgtcatgtgtgagtgttcgattaggctttggagactgccaggctgaccggagtgcttggtgtagttcgtgctctgtaggcgttcacctctcgtctagtagtatggtgttagctgctctgattccagtctgaaataacatgtttagatgggcattgatctgatcacatgtttcaatcacgccttttgtgc

SEQ ID NO: 8023 - DNA, 404 bp, Triticum aestivum
  Clone ID: LIB3281-058-P1-K1-F10
cggacgcgtgggctagatgcacatacaacatctaataaccaggaaatcttctcccctcaggagtgcaaaagctttggagggagagagatgagagtgaggaggagatgagtgagaggagcttaagtccaaaatttaacccctaaaaactatataatccatcagtcaaatcccataagtataatgagtctaggtaattttaccacaaatctttttgtatgtaaataaatttcaggttcagatgcaggtgcccttcttgtaaatttgggagctctagtttgggggggatggggtagaagaaatctagagggcggggatcagggacagagggcacatgaaacacaaagtttagcccttttgtatgaatcatttttttcaagagtccctttgccttccttctggattag

SEQ ID NO: 8024 - DNA, 306 bp, Triticum aestivum
  Clone ID: LIB3281-058-P1-K1-F11
cccccatcatggaccaagcaagggggattgactgcagcaaggcgaagaatgttgcggctaataagttcggcgggccaaggaagaaatccgtgaccaagtccatcaaggctgggctccagttccccgtcggccgcatcgggcgctacctcaagaagggccgctacgcccagcgcgtcggctccggcgcccccgtctacctcgccgccgtcctcgagtacctctcagccgaggtgctggatctggccgggaacgcctccaaggacaacaagaagacccggatcgtgcccaggcacctgctgctggcca

SEQ ID NO: 8025 - DNA, 238 bp, Triticum aestivum
  Clone ID: LIB3281-058-P1-K1-F12
cccactcgttcgtccattctcttctagttgcttcgaatgctgctcatagtcccttgcatggggctctgctagttggtgagcggggtcctactccacgtacaagcccaggtacacgtcgcgtcgtgctgtatttgtcgctgaattgctcacctagcgatggacgtccccttttgtttgccctattctacgtcctagtccgggtgcttctcggcgtccctgaccgcgtagtcctagttcg

SEQ ID NO: 8026 - DNA, 380 bp, Triticum aestivum
  unsure (1)...(380): unsure at all n locations
  Clone ID: LIB3281-058-P1-K1-F2
tcccttccgacccagcgtctaattaatcactttcttctcttacaaaaacttttttttttacataaatactcaatcataggtagagcatatcttattgcgtgggctgcactncaccttattcttcctattaactcaatattaatttaactccttgttatattcctccatcattttgattatcattacatatccatttttaattacaaaatcttgactgaatttactcttccactaaccttactctaataaaactcctttttaccctctcataccatctactatttttaaatcacctatttaaaattaattcttacttctcttcattatacttttactcttatcacatatcttactacatatcactaattatattttataac

SEQ ID NO: 8027 - DNA, 132 bp, Triticum aestivum
  Clone ID: LIB3281-058-P1-K1-F4
cccccttggaccttcttgggagggtacgcgccgctggcgccaaggggcgtggcctggtcggcattgcaacggcgggccggaggcgggtgaccgccttcgtcgcgccaccccgcgcgttgtccggagagggcg

SEQ ID NO: 8028 - DNA, 280 bp, Triticum aestivum
  Clone ID: LIB3281-058-P1-K1-F5
gcgtccggctatcttcatccactctagaccctatcttcttgcccacagccaggcacatgcgcgggcgatttactggcgagagggggtagagcgcttcgagcttaattggaggtgtccaggtattaacttctgaatctgtgtcgcgtggtggaaatctggcgttgtggtagtccgattcctctgttcgtgccatcgtggctgcgatatgttcctgttctgtgtctgatgtaaccatcttgttaccatcagcaatgaaaagttggctatcggatctgaattc

SEQ ID NO: 8029 - DNA, 250 bp, Triticum aestivum
  Clone ID: LIB3281-058-P1-K1-F6
ccaacccttccgccaacccttccgccaacccttccttccactcatccgtccatgcatgcgggcgggtgaaccctttgtcgaggcggagagtcatcttcaccaacttagaaatgtataatacggacgaactcagaaatctatatatcgacagaaaaccggccactataactttacaaaacacctcactatcttgtggtacgagcattctaacaaatgttcatttaagctgttaaataaaaaaatcaaccaa

SEQ ID NO: 8030 - DNA, 361 bp, Triticum aestivum
  Clone ID: LIB3281-058-P1-K1-F7
ccaaggtgtgctactagtagtaggggggaggcatgtagcatgacagtgcaaacaggcaaagagttgactccatattctgtaattacttacacatcaccagagcaaaaaaagaaggaaagggctgtaatccacacacggtgcaaactagcgacactcggatcgacatacttttgacagattaagtacatacgacatgtagatcgaccggcgcaaccattttcagcatgttctcgggcacccccactccacacatagcctgaggtaggaagaggatgcaacccaaggacccttctacctggtgaggtagtacactagcatgaagagcgcgacgaatgacgccacgagtgtccccatcctcctg

SEQ ID NO: 8031 - DNA, 255 bp, Triticum aestivum
  Clone ID: LIB3281-058-P1-K1-F8
aaaggagagcgagaacggcaaacccgggcaccaacggaggcggcagcccaacccccgcgggaaaggcacaccgcaacccaccaagggacggccacaagcccaaccgaaaacaaaaaacgaaagcagcaacagcaaggcggaaccccaaaacaggcagcaagagggcaaaaaagagaaaagacaccagagcaagcaccgccgaacaaggacagacacagacaccccaaaccgaaaagcaacaagcaaaagggcaaa

SEQ ID NO: 8032 - DNA, 458 bp, Triticum aestivum
  Clone ID: LIB3281-058-P1-K1-F9
cccacgcgtccggcttataatcgctcaccgttttaataccgtcatcgactgtgacaggttggttattctaagttctgggaaggtttcggaatttgacacccctgagaatcttgtgagcaacgaggaaagtgctttctccaagatggttcagagtacaggacctagcaatgcagagtatcttaagtctcttgtgcttggaaatggtgaagaacggctgcgaaaggaagaaaatgagttgcaagatactcagaggaaatgggctgcgtctaaccgatgggctgttgctgcccagtttgcgcttgctgctagcctcgcgtcatcccacagtgacctcctctcgttggaggctgctgagggaaataacatcctcaggaaaacaaaggatgcagtaatcaccctgcacagcgtccttgaagggaagcacaataccgaaatcgaggaatcgctcaccgagtatg

SEQ ID NO: 8033 - DNA, 463 bp, Triticum aestivum
  Clone ID: LIB3281-058-P1-K1-G1
cccacgcgtccgcggacgcgtgggtgcgctcctgcgccctggtcgtctcgacagaaagattgagatcccgctaccaaacgagcaatcaagaacagaagtacttaaaattcatgcagccggtatcgccaagcatggagaaatagattatgaagcggttgtgaaactggctgaaggattcaacggggctgatcttcgcaatgtctgcaccgaagctggcatgtctgcaattcgcgcagagcgggactacgtagtccacgaggacttcatgaaggccgtcaggaagctgaatgacgccaagaagctggaatccagcgcccactacagcgcagactttggcaaagactaaggcgtagtggtcactgatgtactaatagcagatcctgcagcaatggagatgccccttctctgtaagcgtgcgggagttcagcttcgctgtaggcatcgaagcaactggctgggaagc

SEQ ID NO: 8034 - DNA, 223 bp, Triticum aestivum
  unsure (1)...(223): unsure at all n locations
  Clone ID: LIB3281-058-P1-K1-G10
cgtactcgtgttcgttactcatgcattcttactttaccccctactactaccatcgaggtgacctttnttcctggattgggggtggacctaattcattttcttccctttcaccaatcattccaatttgccaaaataccctccatttcaaattgcccaattaatctttaaatcaacacctttagattccacggccacttttttttatattcacaaatcacttacc

SEQ ID NO: 8035 - DNA, 462 bp, Triticum aestivum
  Clone ID: LIB3281-058-P1-K1-G11
accacatccgccgcacacgcacacgcgcctagtgatggagtgagaagcatcagggtgcttgggccgccggccattggcggcgggccatccatctccaccgccacctccacctccgtcccccgtccgttcgtcatgcgtacaagccatccccacacctgacaacaaccacactccacaaaaccacccccgacccccctccctccctgcattcattcccattcatcttcgatctcccccgagacctcgctttcttgaccgctcgctccgacgcgccgcgccgccccgccgataaagctcgcagcttctccctctctctctctctcgtccccgctcgaatccgcttctccggctcccggattttcttgcaaggattctgtgggctcctgccaatgctcgccggtctgatccgtcctgcttgctgaggcgctcctcgattcggtcctggaacgcgtcgtgctcctg

SEQ ID NO: 8036 - DNA, 382 bp, Triticum aestivum
  unsure (1)...(382): unsure at all n locations
  Clone ID: LIB3281-058-P1-K1-G12
cagcactctcctcagatgaataatggattgaatgagatgtcatcatcagaggatgagcaagttgaacagggcactggggaacgtgaattgttttccatgccatctgataccatggagcatggattagttgttgacaaatctgaatgaaatactgaagaggtgctggttcaacaagctggcataaaggatgagtgtgacgctatgccaatggaaggtgggccacatgacgcagaggtttcgaacgagaacactgaggagaaccaggttcaacaagctgagctgagccaggaattggattcggtgatgatacatcccanggagcatgtccatgaacaatgtgtagaggagaaaatatcacttgccgagttgaaacaagaattgg

SEQ ID NO: 8037 - DNA, 455 bp, Triticum aestivum
  Clone ID: LIB3281-058-P1-K1-G2
cccacgcgtgggagaacccatagcaacgcacttgttatttgatgatacagactatttcatgggccgctcacttgctctccatagggatgatcctcacctcaataaaccaacacttgatactgtgaaaaggatgaaattatattctgagtctcttgcacgtatccaaggggtctcgccttatatttatcctttatatgggctgggtgagctgccacattgttttgtacgtataagttctgtttattatgactcttacatgttaactaaaccagaatgcaaggttgaattccacatggaaggaaaagcgtgtcgtgttacatcagaaggtgaaaccttaaaatgcaagacagttggctgcgatccttcgtacttcaccaacaaggtcagtaagatcgtcaaatgtacacgtgcaattgctattatcagccattcaatcccatatacaaatgagtccc

SEQ ID NO: 8038 - DNA, 445 bp, Triticum aestivum
  Clone ID: LIB3281-058-P1-K1-G3
cccacgcgtccggggtgctgagtcgactgtagtgtactgcgtttcctcctcctcgtcgctggtcttgttatctcatccccgggtccgacgagccccggcgacctaccggcgagggatggcggcgacggcgacaaagctgagcagcggccacgagatgccggccgtggggctcggcgtctggcggatggactccgccgccgtccgcgacctcatccactccgccctccgcgccggctaccgccacttcgactgcgccgctgactacaaaaacgaggctgaagttggcgatgcgctcgcggaggcgttcgaaactgggcttgtcaagagagaggatcttttcatcacaaccaagttgtggaactcagatcacggtcatgtggtcgaagcctgcaaggatagcctgaagaagctgcgattggattatctagatctctaccttattcac

SEQ ID NO: 8039 - DNA, 465 bp, Triticum aestivum
  Clone ID: LIB3281-058-P1-K1-G4
gtgagggacagggaggctgcaatactggacactggcatctttgtgctaaggatgaccgaccgttcaaaaatcatatgggagagcttggcctctcctactgatacatggcttccaggaatgaatattacacttggaaatttgctgaaatcatggaagagctatgatgacccagcaacaggagattacacttttggttttggaccgagcatatctaatccgtcagcatcacaattcattattatgtggaatcggatttcattttggacaagtgaatcctggaatggtgacacgaattctctcattccagtactgaaatctatgggtatcatccctgtttcatttcagtgtgacaaccttacatgcatgtacactcccaaccctgctgacataatgactaagattgttttggatcaaagtggttcactgaacataacacagttcaattcggaagccaaattgtggaca

SEQ ID NO: 8040 - DNA, 467 bp, Triticum aestivum
  unsure (1)...(467): unsure at all n locations
  Clone ID: LIB3281-058-P1-K1-G5
cggacgcgtgggggagaagctctccagccattgacaacagccatcagatcccgcttgatgatgtcccaacattccttgaaaagaataccggtgaagtcatccggtcccggtgccttgtcacttggtaaggagaaaatagccgctttagtttcctcttcaatgaatggtaggtccagatccgtaagatcacatggctgggtttgaatggcctcccaggtgaaatcttttgaccgtgccggccccttacgaatgaccgtggagaagtgctcatggacaatggctttcttgtcatcatgattggtaacccatccttggttgtgccggagacgatggataaagtttttccgtctctgccgattgattcggagatggaaaaaacgcgtataggcatccccctctttaagcaaggttatccttgaggattgctnttttctagctcgctctaggacagccagagcgacaacctt

SEQ ID NO: 8041 - DNA, 441 bp, Triticum aestivum
  unsure (1)...(441): unsure at all n locations
  Clone ID: LIB3281-058-P1-K1-G6
ctcggcctcgattacttgcacaatccagctgatgacgctcaggcgttgggtcctggcgttgagctgtgggggcggcatttggaatttgtggtgcgccgcctcctcgagtctgagcgtcagctttgcgccaaggtgtttgggcagcacaaggatgatgcatcagtgtgcttcgccgagatagcgtcacgagctagtgttcttgattttttgaggtttggccgtgccgctgcagatgctaagaaagacccaatcaaactcctgcgtttgctggaggtctttgattctttgaataagctgaggttggatttcaaccggttgttcggcggaaaggtgtgtgcagatattcagtgccagacaagggaccttgtgaagttattggtggatggctctgttgagatctttgaggagtngatcgtgcaggtggagctgcagcgacacatg

SEQ ID NO: 8042 - DNA, 452 bp, Triticum aestivum
  Clone ID: LIB3281-058-P1-K1-G7
cggacgcgtgggttaaagcccaaacaaaaaccccgctgcgagatctgcgcatctcggtacggcaccaccacgacgggcgtggcggcgccgcgcgtcctcctcctcctcgccgccgcggcccttctcgccgtcgcctccctcggggacgcttcgggcgagggcccccgcgggcgcaagctgctggtgctcgtcgacgatctggccgtccgctcatcccactcggccttcttcggctcgctccaggcccgcgggctagatctggagttccgcctcgccgacgaccccaagctctcgctccaccgctacggtcagtacctctacgacggcctcgtgctcttcgccccatcgaccccgcgcttcggcggatcggtggaccagaatgctgttctggagtttatcgatgccgggcatgatatgattctggcagcagatcattcggcttcagatctgat

SEQ ID NO: 8043 - DNA, 200 bp, Triticum aestivum
  Clone ID: LIB3281-058-P1-K1-G8
aggggtgcgtggatagtcatgtaggttcctcagatggcggcactgccagtgctgggttggggttcttgggctttacaaagatgccactttagggcctcttcgattcaaacttattttttttcgtatgcaactctttcgtaaggatacattctgtataagtatttcagctgagttaaaattatgagaaaggttttccctgc

SEQ ID NO: 8044 - DNA, 444 bp, Triticum aestivum
  Clone ID: LIB3281-058-P1-K1-G9
gattctcttgagcaccattctaaccactactgtaacggtctccaccctcaccatgggcacgagtgctatgattcagtggggctggcatcgacaccgaagctgtcaagtataagtggggccaagacagaaacgtcatcgatggatgcgtcgatgaggacgagttcatctccagaagaggttgacaggtccgatgagctctcggtgtccatcagcaacgcaagcgaccaagagagggaatgggttgaggaagaccagcctggtgtatatattaccatccgggctttgcctggtggcatcagagaactccgccgtgttcgattcagccgagagaagttcagcgagatgcacgcgaggctatggtgggaagagaaccgagcgaggatacatgaacagtacctctgagacagaagaagaagaagcacatatgaaaacaatactgagaac

SEQ ID NO: 8045 - DNA, 425 bp, Triticum aestivum
  Clone ID: LIB3281-058-P1-K1-H1
taacaggcaacatcacgttacgggagctcctggagtggctcaaggagaaggggttgaacgcgtacagcatatcatgcggcacgtcggtgctgtacaactccatgttccccaggcacaaggagcggctggacaggaaggtggccgacgttgccagggaggtggccaagatggaggtgccatcgtatcggcgccatctggatgttgtggtggcctgtgaggatgacgatgacaatgacgttgacatcccactcgtatctgtctacttccgttgaagggctcccctctgaattgacatcatctcgtgtcccatctttccagtgagttcctttatatagttactgtaaattgggctggggtttaaagcaatatactaattttcgtatgcaccgctccttgataattgatgcatgacaccgttgaactgg

SEQ ID NO: 8046 - DNA, 308 bp, Triticum aestivum
  Clone ID: LIB3281-058-P1-K1-H10
aactctccgaaaatttcacgcgcgctcagcacaagtagcagtttcagtttcagagctccgcgtcagttagccacaatgcctggcctcgccaagcccgccgccgcggcaccgaagccgaagccctccgccgccaagccgaagaaggccgtcgccggccccgcccacccggcctacttcgagatgatcaaggaggcgatcgcggcgctcaaggacaggaccgggtccagctcggtcgccatcgccaagtacatcgaggagaagcacggcaagtctctcccggccaacttcaagaagatgctctccgtcca

SEQ ID NO: 8047 - DNA, 333 bp, Triticum aestivum
  Clone ID: LIB3281-058-P1-K1-H11
ccccgcccgaatattccaagctcgcgtcttgcggcggcggcggcgagcaggcggcgagcagacggagcccaggccggaggaggccccggaccccgattccgcctccactcggctggccgagagaggcaacggagccactatgcctggagcagatgagacgtttccggcagagtcgagggcgacggtgttctttggggctgtgacatctaaatcggagccgctgacctttgaagagtccctcagatttgtcaagaaagtgaaagtgagttcctgtgttccaacactttatttatttatgtatgcttgtacatgatttatatccctctgggtata

SEQ ID NO: 8048 - DNA, 379 bp, Triticum aestivum
  Clone ID: LIB3281-058-P1-K1-H12
ccacgcgtgcgtcggatcggatgatcccaagccgccgcagccatggttcgcggatcgctcgggagggtggcgtcgcgcaccctctccgtcgccggcaaatggcagcaccagcagctccgtcgtctcaacatccacgagtaccatggcgcggagttgatggggaagttcgggatcaacgtgcccaagggcgccgtggtggggtcagtgcaggaggtcaaggaagttttgaagaacgttttccccagtgagaaagagatagttgtgaaaagccaaatccttgcccgtggccgtggattgggaactttcaaaagtggactgaagggtggtgttcatattgttaaggctgaggaggctgaaagccttgcagcaaaaatgctta

SEQ ID NO: 8049 - DNA, 93 bp, Triticum aestivum
  Clone ID: LIB3281-058-P1-K1-H2
cggacgcgtgggagaattgatagcaaagtacggcttatttgatgatacagtggatttcatgggccacgcgcttgctctccatagggatgatcg

SEQ ID NO: 8050 - DNA, 92 bp, Triticum aestivum
  Clone ID: LIB3281-058-P1-K1-H3
cttctcctcaataaaccacacacctcctactgtttaatgtatcattcatgattcatgcattgttaactgtcatggatttgccgtcgtgattc

SEQ ID NO: 8051 - DNA, 452 bp, Triticum aestivum
  unsure (1)...(452): unsure at all n locations
  Clone ID: LIB3281-058-P1-K1-H4
tcgcccacgcgtctgatgcaacctctattacagaaatgatgcaggtctacataattagagcaaattccnacnacnaaaaggacagtgtgttgattcctttagcttcaactattgcgacaacagcatgtaagttgttcttacggttttctgcattggttctcaacaattcaagttttcaaaaaactaaatccttttttttctgctatataaccaattccttctactatgaggctttgtgccccaaacttaatgattcttttctgcatttaaatttccaacatgtttttgaacagcacagtttactatatagtagatttgaagaggaaattctggcttactatccttctttatccctagatgatccttctcttgctgatgtgcacaatagttaaaccatttccagttaaacatcatatttgaggttaaacagtcgacttctataaagaactgac

SEQ ID NO: 8052 - DNA, 365 bp, Triticum aestivum
  Clone ID: LIB3281-058-P1-K1-H5
gagccacgcgccacgcgtacccgtgggtgctgatgtggctgccgcagcggcgggtaacgccccaccacagatcccagatctggacgctgctgagggcgacagtgaggagcagcttgcgaacaacgaagaagctgcgaacaacgaggcagaagctttgcccaacgatgcagaagctggggccaatgaagaagctgtgaaccaagaccaagacatgggcgacgaagcggaggaggaggatttgatcgaggaagaagcgggcgcgagtcacgcgcaaggtccggtcagggacgtggcgatggagaacgagctcgccaacgagctgacgggcgatgccctggacgactatgacatcgacgtcgcgaacg

SEQ ID NO: 8053 - DNA, 384 bp, Triticum aestivum
  Clone ID: LIB3281-058-P1-K1-H6
acgcgtgctgcgcatggagagagactacagccgaggtagccactgatggtggctaccatgaggagggcgaggaggactactactacggatctgctcgttcgctcgacgggggatccgtctcctctgccgcctatctttaactacatgttgccgtgctgtcctgttttggaaacttgtgttgggttgttaagccgtcggtgctttctttgtcgctgttgaactgcatcattagtacttcagggaacaagtatctcgcttaatttgttctgtcctgcccggtcctgtctctgctcttggtgatcggatcatatttagtagctgaatttgattagcccggacggtggtcgagattctccccgcgcgaacggaccaccggcggggatt

SEQ ID NO: 8054 - DNA, 448 bp, Triticum aestivum
  Clone ID: LIB3281-058-P1-K1-H7
cccacgcgtccgagccaatctcgccggataaagaagcgtctacgatgtccttccggggcaagggatgtaaggggctgggcaagggcttctccaatctccacctgaaggtgctccgcgacaacatccatggcatcaccaagccggcgatccgccgtctggctcgccggggcggcgtgaagcgcatctcggggctcatctacgaggagacccgcggcgtgctcaagatcttcctggagaacgttattcgcgacgcggtcacctacaccgagcacgcccgccgcaagacggtcaccgccattgacgtcgtctacgccctcaagcgccagggccgcaccctctacagattcggcggctaggccacgcgaatctatccccccaccaccatatttgtgctcgtagctagctatggctgtgtattgttcatgggcttcggtgtaatggctgcatc

SEQ ID NO: 8055 - DNA, 363 bp, Triticum aestivum
  Clone ID: LIB3281-058-P1-K1-H8
cggacgcgtgggcccaaacaatccaccaagcaaacccgatggcccgcacgaagcaggcggggaggaagtccactggcggcagggcgcctcggaagcagctggccaccaaggcggcgcgcaagtcggccccggccaccggcggcgtgaagaagccgcaccgcttccgccccggcaccgtggcgctccgggagatccgcaagtaccagaagagcacggagctgctcatccgcaagctgcccttccagcgcctcgtcagggagatcgcgcaggacttcaagaccgacctgaggttccagtcctccgctgtgtcggcgctgcaggaggccgccgaggcatacctggtggggctgttcgaggacacca

SEQ ID NO: 8056 - DNA, 177 bp, Triticum aestivum
  Clone ID: LIB3281-058-P1-K1-H9
gaagcctctaggcactcgggttggggagttgttgatcttgcttgtgtgcacaatgtagagtgctagctggtaaggcttgttggtcctgtgtaacttgagagacgaatgctacgttagtctattgttgcattcatgattcatgcattgttaactgtcagggatttgccgtcgtgattc

SEQ ID NO: 8057 - DNA, 480 bp, Triticum aestivum
  unsure (1)...(480): unsure at all n locations
  Clone ID: LIB3281-059-P1-K1-A1
gcgtccgcaccgttccgagcaagaacataccatcggcgccagcactagtatccacctccncctcgacgaaagtgctaggcatacagggtcagaacnccgctccttctgatccttctgtaggatcatcaacggcgcacaagaaggacgggccgcttgccgccaaaatcccagccgagaagaggaagatggatgccaggaagaagagcctgaagaggctgtaacagcgcaccccgccggatagcgttgacgcgggctgttgtagtagctagtagagtcaatccccttgataagcgccgccggattcagcagatgcacagcggaaccgaatggataaataaacccaagggacatctcatgaatctggtggctgattggtagagaagtatgcctgtactcaggcattagtgagatgagacgcatgtgagctggtggtctcctgttggaataaactgtggtgatgtgcaatgaccaactatttgg

SEQ ID NO: 8058 - DNA, 279 bp, Triticum aestivum
  Clone ID: LIB3281-059-P1-K1-A10
aaaccccccgcggcccacgcatccaaaatcatctaatcatcgatcatagcccgttatagtcttttatctaataaattctccccggccatatattaaagtatgggggacaaaataaaactacaatattcactactttccattatagcataaatcctcaaatcatctcatcccctctcaccaccaccatccttactgcacattttcttcctccactcacccttactttaccatatccccttaataaatctaaccaaatcccacacctttactttccctttt

SEQ ID NO: 8059 - DNA, 575 bp, Triticum aestivum
  Clone ID: LIB3281-059-P1-K1-A11
cccacgcgtccgatccagtccagagcggcagtatttatagccagcgcctcccccaccaggaccaccaccttgcccctgcggctcctccgatcgcatctcctctcctccgtcctcccctcccgtcgcccgtctcagcctcctccgagctcgctcgctcgctcgctcgccacgacattctgtaggaaatggctgacggtgaggacatccagccccttgtctgcgacaatggaaccggaatggtcaaggctggtttcgctggagatgatgcgccaagggctgttttccctagcatagttggtcgccctcggcacactggtgtcatggtagggatggggcagaaggatgcctatgtcggtgatgaggcgcagtccaagagaggtatcctcaccctcaagtaccccatcgagcacggtatcgtgagcaactgggatgacatggagaaaatctggcatcacaccttctacaatgagctccgtgtggcacctgaggagcaccctgtgttgctcactgaggctcctttgaacccaaaagccaacagagagaagatgacccacattatgtttgagacttttaat

SEQ ID NO: 8060 - DNA, 580 bp, Triticum aestivum
  Clone ID: LIB3281-059-P1-K1-A12
tccgaaggtaatggagcttgtccgtctaggatgcacgtgcggacgcatacgaccaggtgggtgcattgttcatggccagtgttctggagatgcaaatcttcgctgagttgagagatgggctaggattgcatctatttttaggtcctttcaggtgaaaatctgagctactattttgttttcttgaagagcatcaagtttatgatcaagaacgccctcaatctggtcggtccatttcttggattgcatctatttttaggtccatcacttcaatctgccaggttttattgcaaccgaacagatgttgttcctcctaactgaacttaaatttacgtgtgctttaagagcagatattagttagtttctgatactcatgattaatggaaaattccatctagtgatgcgtccattttatgtgtgctttaagcgaattatcttgatagcacatggattgcctggaatgccaaccatgtcttgattgaaagctatttcttgtactgcaaacatttacacattgtcgtaccaaccctgcgagttttatggataggcatgtctttgagaacaataatatcatcacaggtct

SEQ ID NO: 8061 - DNA, 466 bp, Triticum aestivum
  unsure (1)...(466): unsure at all n locations
  Clone ID: LIB3281-059-P1-K1-A2
atgctnanctgtggcggcaatgtagaggtggcggaggcgcagacgccggtgttcgcgtgcgacgcgtcgaacgcgacgctggcgtcctacgggttctgcaaccggaaggcgtcggcgtcggcgcgggccaaggacctggtgtcgcggctgacgctggcggagaaggtggggttcctggtgaacaagcagccggcgctggggcggctgggcatcccggcgtacgagtggtggtccgaggcgctgcacggcgtctcctacgtggggcccggcacccggttctcgccgctggtgcccggcgccaccagcttcccgcagcccatcctcaccgccgncttcttcaacgccttcctcttccgcgccatcggcgaggtggtgtcnacggaggcgcgggcgatgcacaacgtggggctggcggggctcaccttctggagccccaacatcaacatcttccgggacccgcggtggg

SEQ ID NO: 8062 - DNA, 555 bp, Triticum aestivum
  Clone ID: LIB3281-059-P1-K1-A4
cggacgcgtgggcagcgccactcgcaccacagtcatccactcacaagctaagctagcggcgcagtagctcacttcagtccaggcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccagaacctgctggcggaggccaacaacagccccgaccgccgcaccatctgcggctgcctcaagaacgtcgccaacggcgcctccggcgggccctacatcacccgcgccgccgcgctccccttcaagtgcaacgtcgccctcccctacaagatcagccccagcgtcgactgcaactcgatccactgaacgaactgaagcgccttggcccgtgtgtcgacgtacgtctgccgtgcgaggagtcccatgtccggagaataaattgctgctactaggactgaagcttagcta

SEQ ID NO: 8063 - DNA, 558 bp, Triticum aestivum
  Clone ID: LIB3281-059-P1-K1-A5
aatgggtcttaatctgaacatttctagaattattttctctacactgaagaagtttgatgggatctgcaccagggaactgactgtccctgagatcaaacagattgctggcagagctgggagatatgggtctaaattcccagttggcgaagtgacctgtttagacgctgaagatctcccgttactgcactcatccctgaagtcaccttctcccattatagagcgtgctggactttttcccacatttgatttattgtctgtgtattcacgattacatggaactgactttcttcaccctatattggaacgtttcttggacaaggctaaactgtctccggactattttattgccgattgcgaagatatgctgaaagttgctgctattgttgatgagttgcctcttgtgttgcatgataagtacgtcttttgtcaaagtccagtggatgtgagggatgatatatctattcagggattaacacagtttgcaaaaaactatgcaaagaaaggcacagttcggcttaaagaaaaatttacacctggaacactgggggtgcctacaac

SEQ ID NO: 8064 - DNA, 456 bp, Triticum aestivum
  unsure (1)...(456): unsure at all n locations
  Clone ID: LIB3281-059-P1-K1-A7
gtcccctccctcatcctcccccgcagatatatccanccagatcctccattcgtggctaccgccggcaacgcgggccgctcccgcaagcgcgtcgaggccaccgtcctcaagcgcgcgcgcgacggaagcgccttcacccgctgcgaggcgtgcaacaaggacgtagccatcgtcctcatcgacctgcacagctgcagcctcgactccaagatacgcctcagcctcgagtcgcaggtggtggagaaggccgtcgagatccaggagaagaagaggaagacgccctccgctgccgccggaggcaaggggaagaagaagagcaaggcagactgagatggtgccaagaagccaaaagcaaagcgcccaccaactgccttcttcctcttcatgaaggacttcagggttgagttcaaggcctctcaccctgacgagaagggtgttgcccgccgttggcaaggc

SEQ ID NO: 8065 - DNA, 572 bp, Triticum aestivum
  unsure (1)...(572): unsure at all n locations
  Clone ID: LIB3281-059-P1-K1-A9
gaatcatcggatcagcgagcagagcccgcgttagccttttatctaataaatgcncccgggccagaagtcggggtttgggggagaaaatgagaggacaagtggaggagtttccgtgagaggggaaagcggcggagcagctcagcccctctgaccaccaccatccttcctgcacaatttcttcctcctcgcaccgctactttaccgtagcccggaaagaaagctaaccaaatcccacacctttgctttcccctttcccctctccttttcccctctcgccctcggctcccaattgtctcgccctctctcctcgcctctccttcaccacctaccagtccgtgtgcttgaccagagggagggagggagcctgaagttgtctagatccttctttctccaatccggggctgcttagctttccagctggccgccgactccaagattgcggaccggcgggcgtttcttcctttccaatactgatataggagcgggctacctgcgaggatgtgagagtttcttttcttgtttcggtggagttgttaggaatcaacagtccgagtgttgcggatgatctggaa

SEQ ID NO: 8066 - DNA, 397 bp, Triticum aestivum
  Clone ID: LIB3281-059-P1-K1-B12
cgggccacgcgtcctgcattctgccatatccttgagagctccattatcatcttccccatccggccttccttcgcgtcaccatcagcgggcatgggggcctgcactacgttgaatctacctctggatcctacgtctagtagtgtgaaagtgtctttctctggcaaataaagtggggctgcattttggatcttctctacgtggttgataaacttctccttaccgccacgctggttggtaaaatgcggaggcaaggattatttctggcaccctatccttcctgaacttacctcatccggatccatcccgatttttaggccccttctttttatctcaactttctcccgaaatccttgctgtaataaattccaatatccggggcgacaggcttttatttctc

SEQ ID NO: 8067 - DNA, 600 bp, Triticum aestivum
  Clone ID: LIB3281-059-P1-K1-B2
cccacgcgtccgcccacgcgtccgcggacgcgtttttcgggtagtttgttgcaactcaccgctcctggtgcagatgagggcgtgctccctgcctatgatgggtctcatcttgttagtgcttccgctccacctatggcgctcattctgcggctggggacttcatcgacatcaagtgaagctttgttgtccattatgttgtagtgcttggtgttgttgaggtttgtaagttgtctagtagcaccatgtatctgccgtctttttctttttcctcttgttaggtgctgtccgatgtaactcctggccggttgatggctttgttaattcaaagccgggctctctctcgagccttcgttctaaaattaaaaaaaaaaatctatatagggaatagctcgcctcctgattcgtccactcgtcaaccgtcagttgatcctggagtagctctgaggctcaggttttctgatccgcggttgcttcatctgtataggtcttttgtgctgtgattgggtttactgatccaaacccttattcataacttttccccgatttgaaccaaaccttcatgtttcctttcttttctttttgagcccacaaaatttttta

SEQ ID NO: 8068 - DNA, 189 bp, Triticum aestivum
  Clone ID: LIB3281-059-P1-K1-B3
gactaaacaggaagccatgttactgaacttcagtttcatcttctgctcatagattcatgcgtatgaataatccttctgtctctttatgaactgctccacatgttaaaagcttgacgtgctgttgttctcacagcattgtactccctctgtaaacaaatgtaagacgttttaggtcactattacattata

SEQ ID NO: 8069 - DNA, 576 bp, Triticum aestivum
  Clone ID: LIB3281-059-P1-K1-B4
ctgcaatggccggcaagggcgagggtcccgccatcgggatcgatctcggcacgacctacgcgtgcgtcggcgtgtggcaggatgaccgagttgagatcatcgccaacgaccagggcaaccgcaccaccccctcctacgtcgccttcaccgactccgagaggctcatcggcgatgcggccaagaaccaggtcgccatgaacccggtcaacacggtcttcgatgcaaagcgtcttattggcaggagagttagcgatccttctgtccagagtgacatgaagctgtggcccttcaaggtcattgctggacctggagacaagcctatgattgttgttcaatacaagggtgaggagaaggagtttgctgctgaagaaatctcctccatggtcctcatcaagatgcgtgagatagctgaagcgtatcttggcagcaccatcaagaatgctgtggtcactgtccctgcctacttcaatgactcccagaggcaggccaccaaggatgctggagtgattgcaggcctaaatgttatgcgcatcatcaacgagccaaccgctgctgctattgcttatgggcttgaca

SEQ ID NO: 8070 - DNA, 581 bp, Triticum aestivum
  Clone ID: LIB3281-059-P1-K1-B5
ccggttcttaatacccggttcgacgcgcacgcgtccgcggacgcgtgggccgacgaacgccgaggaagtttttgtgagaggaggattgaagaggagggggcagatctatgggcaacggcgggagttcatctcgtgcacgcctaggaaaggcccatgtcgttccggattcagaatggaggatgcaggactttggaaagacccatgttcctgatttagaatggaggattaatgacttctcatcgctgcttgagacaggagctaagtcagcaaaatctgacgcttttcactgctctgggtataactggtacctgcaagtgagtccaatgcataaggaaattggttctgaaacgccatatgttgctctttgtctgaagatatcccaagcaagtatggtgccaggtcacacggtgcatgtggtttttgagttgtcaatatacaaccatacaaaaggaatgtactgcggatgcaaagatacctacaacttccatttcaagaatacctactcaaaggagcaatgcttgattcctcttcaggagctactgaaatcatctgctattctagttgatgatagttgtgtgttt

SEQ ID NO: 8071 - DNA, 537 bp, Triticum aestivum
  unsure (1)...(537): unsure at all n locations
  Clone ID: LIB3281-059-P1-K1-B7
ccgatccaaagattggatctgaccgctggatctgcgaccgttccgtcacgtcncggagctcgaatttatttgggcgcgtgtagtttgtgcttctactatctatacgactttcgtgtgatatatccgactcgtggggttagatttgcgcatgaggatgtgtgttgagccgtttgttttttgggctggatcccgtaatggagatctgagcgagtaatggtcgcgaattgcaggtgttcggaagaggggtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatagggttcaatgttgaaactgtcgagtacaagaacattagcttcactgtttgggatgttgggggtcaggacaagatcaaacctctctggaggcattacttccagaacacgcagggtcttatctttgttgtggacagc

SEQ ID NO: 8072 - DNA, 239 bp, Triticum aestivum
  unsure (1)...(239): unsure at all n locations
  Clone ID: LIB3281-059-P1-K1-B8
cggacgcgtgggtttttttttttttttttttttttttttttttttttttttttttttgtttttattattttggttttgggtgttttaaaanaanaanaaacaaaccacaaaatatcctttttcccccccccgccctttccggtgttaaccctaaaaaccttccattttcaaaccggtatcatttacaattaagtaaaggaaaaaaaacctttttcaaaccctcctatgccccccccttt

SEQ ID NO: 8073 - DNA, 469 bp, Triticum aestivum
  unsure (1)...(469): unsure at all n locations
  Clone ID: LIB3281-059-P1-K1-B9
gcgtccggtctcattgacttatacaccagttcttcttatatgaaaccagaacacatcattatgtggcgacatgctattagcgacaggcacttataatcaattcacacaacattaaattgaataaaatacttgaagcctacaagttcttggatgaaaactgtaacctaaagatcacacttatttttactcacaaaaatcaccacaccaagttatttatacctggatcttctgacaatttccttcctngcactgttgtatataatacagtctgccatccaatgaataatgacttctacatgtgctctcattctgcaatcattactactacaacgccaactcactaccatatactgcatgataacatacactatgacgaagattacctgcaagatcttgtgcactccctctcatatttgtattaaaggagcactacacacatatcatttctttctccaatctgctatgcaca

SEQ ID NO: 8074 - DNA, 579 bp, Triticum aestivum
  unsure (1)...(579): unsure at all n locations
  Clone ID: LIB3281-059-P1-K1-C1
gcgtccggtgccactcagttattaaagaagttggccttcacaaccactagaaacagganccagttgggtgttgttcgtgaaattggtgcaataggtggcagtgcgaaagcatcagccaaccgtgagctcatgagctacagttatggagcccttaagacttacatgcctgaaatggtggaagtgctagttgattgtgtgagaaatcctgctttacttgattgggaagtcaaggaagagataatgaaactaaaggcagagcttgcagaagcttcaagtaatccggaagctttccttttggatgctcttcattccagtggctattctggtgccttggcaaacccattgattgcctcagaggcttcaattagcagattaaatacagatgttctggaagaatttcttgctttgaactacacttccccgcgaattgttctagctgcgtctggtgtggaccacaatgaacttgtatcaattgctgaaccactcctgtctgacattcccactgcaactggaacaggaaagccaaaatctgtctatgttggtggagaatatagacgggcagcagattcatcgaacaca

SEQ ID NO: 8075 - DNA, 375 bp, Triticum aestivum
  unsure (1)...(375): unsure at all n locations
  Clone ID: LIB3281-059-P1-K1-C10
cggacgcgtgggttcaccgccgccagcgccatagtctccaaaccctcgatctcccgcagcngagctccctggcgcgagggggccacccacacccaaccatggcggaccgcggcggcgagcgtggtggcgaccgcggaggccagcgcggcgggttcggccgcggcttcgggcgcggcggccgcggcgaccgtggcgggcgccacaggacccgtcttggccctcgtcaggaggaggagaagagggtgctcctcaccaaactgggccgcctcgataaggagagcctgtataacactagggaggagctctacctgcactcgctacccatcaacgagtacctgatcggggaccatctctatcttgggctcaaggccgagg

SEQ ID NO: 8076 - DNA, 571 bp, Triticum aestivum
  Clone ID: LIB3281-059-P1-K1-C11
gttgcatatggtgaaatgttgaattttgagatttctattggtttttatgaacttgctggggacttcaaccgtgggtgggcggaggcatgcaacaacctgggagtaatatacaaggatagggataatctcgacaaagctgttgaatgttatcaaatggccttgtcaattaagccaaatttctcccagtcattgaataaccttggagttgtctatacagttcagggcaagatggatgctgctgcaagcatgattgagaaggccatacttgcaaatcccacttatgctgaagcatacaataacttaggtgttctttacagagatgctggaagtattacgttatctgtacaggcatatgaaagatgcctgcaaattgatcctgattcacgaaatgccggtcagaaccgtttgcttgccatgaactatattgacgagggctcagatgacaggctttatgatgctcacagggaatggggaaagcgctttatgaaattgtatgcacagtatactagttgggataacataagagtcgctgatcggcactggtcattggttatgtggcttcctgaatttt

SEQ ID NO: 8077 - DNA, 573 bp, Triticum aestivum
  unsure (1)...(573): unsure at all n locations
  Clone ID: LIB3281-059-P1-K1-C12
ccgtgtgtttggtgcccttaagggagctttttacggtggtcttgacattccccacagggacaagagatttggtggttggggaaaggatganaagtcnctggatgctgagattcaccgcaaggacatctttggagggcatgttgctgactacatgaggtcactagcagatgaggaaccagagaagttccaaactcacttcagtgagtacatcaagaggggaatctcagctgatgacatggaagcagtttacaagaagggtcatgctgccatccgtgctgatcccaccatggccaaatcaaccaaggcgcctcccaagactcacaagagatacaaccccaagaagctgacctatgagcagaggaaggccagcctcgttgaaaggctcaacgccctcaacaactctgcgggtgccgccgatgacgatgaggacgacgacgagtgaagagctctttgtccaccccagtgtagtcttgcaacgtgcgtttttggtaaagtgcggcactctgcacaatgacctggtccattgagttctgtttgtgctgctggagttatagattgtgttatctgggttat

SEQ ID NO: 8078 - DNA, 525 bp, Triticum aestivum
  Clone ID: LIB3281-059-P1-K1-C2
acccaatttcattgccgcactgaccggtctgtactaattggtggtgccccctggataacgtgccatatcccttgcaggggggtgctccaacttttgatgctggcgaagcttttgccatgatggctgcatcatttgttgctctggtggagtctactggttccttcattgctgtttcaagatttgcaagtgccacacctctcccaccctctgtacttagccgtggtattggctggcagggtgttggtatccttctggatgggttatttggaactggaaatggatcttctgtatcgattgaaaatgctgggttgctagccttgacacgtgttggtagccgaagagtagtgcaaatatcagctggttttatgatattcttctctatccttggaaaatttggagctgtctttgcatcaatacctgcacccatctttgcagccctctactgcgtcttctttgcatacgttggttctgctgggcttggctttcttcagttctgcaatctcaatagcttcaggactaagttca

SEQ ID NO: 8079 - DNA, 569 bp, Triticum aestivum
  Clone ID: LIB3281-059-P1-K1-C3
tgagagtccagaaggctcaggagacgactatgcgcctgccatcggtgcaaacaggagggtgggtgcacgcaggcatacacctgggccctctcccaaagacctgcaggaaaggtcagccatgcaagctgcgagggccaaacgaaaggctggagatgaagtctccacactgagaaataaggtggtagtaacagaggaaagtcgccccaaaaactcccaggaaagtgcagtcttggaatctgcgagggataaaagaagggctgaagatgaggcagccgctctaaggaagaaggtgatagcgatggaggaaagtcagagaaagctgcaggaggacttggcgagagtgacgaatgcaatgagtgctatgcagaagatgatggcaactggtggcttaccaaatcgaaatgggtgaaccagcggtacaaccaagtttccaacagattggacctgattggctgatgcttggagtacatacctgcaattgtttctgcctttagcttgctgatcctgcaatcgtatctatggatcctagttttagatgtgcaatctcttgtcatgtttttttccgtggc

SEQ ID NO: 8080 - DNA, 545 bp, Triticum aestivum
  Clone ID: LIB3281-059-P1-K1-C4
cctccacctttcccccgccccaccttcccttgctggtcgccgtcttcgccttgctctctgccgccaaccccacccccaccctgtccccgtccgccgcttctcctgcctcccctcccgccgccggcccgtaggaacccggtctgcttgctgcctcctccggagaagccacggtttctgcccccgcctcgccggatatcctcgcccgacccgccggcccgctcgcttcgattcgtttcgtttgttcgattcttgctcccctgtcctgctgtacatatccgctcggtcggcgcccggatttctcggcggcgtgtctggatctgagctcgcgcgcgaaatcccggctcgattcgctcccaggcgccgcggcggccggtttggatctcgcggggttaagagaggggaggggagggggtcaaggccgttgattcgtcgggagccaggcagcggtactcggggatggatcacatcgtcggcggcaagttcaagctcggcaagaagatcgggagcggatccttcggggagctctttctcgctgtgaatgtgca

SEQ ID NO: 8081 - DNA, 88 bp, Triticum aestivum
  Clone ID: LIB3281-059-P1-K1-C5
cccacgcgtccggtaatagttggcgcttcatttaccagcaaaaatcaatgtggagttgcgagtccatgttgtcatcatcattcaggga

SEQ ID NO: 8082 - DNA, 456 bp, Triticum aestivum
  Clone ID: LIB3281-059-P1-K1-C6
gttcgggtccgagagtagctagcctagtctagtgtttccgtagttcggagaggagagagaggagagatccatggcggaggcggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctaccgcggccagggcggtggcggctacggccagggaggcggtggcggcta

SEQ ID NO: 8083 - DNA, 539 bp, Triticum aestivum
  Clone ID: LIB3281-059-P1-K1-C7
cggacgcgtgggcaagaattcctcccaccctctccgtctcgccgccgtcaccaccgcgggtagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtctttctccctctggtcctctctgctctgctttctgactcaaaactgcaacaatg

SEQ ID NO: 8084 - DNA, 581 bp, Triticum aestivum
  Clone ID: LIB3281-059-P1-K1-C8
tgctcagctgagaaggcttaccatgagcagctgttcgttgctgagatcaccaacagcgcgggtgagccttcgtccatgatggccaagtgcgacccccgccacggcaagtacatggcctgctgtctcatgtaccgtggtgatgttgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccagagggctgtgtgcatgatctccaactccaccagtgtcgtcgaggtcttctcccgcatcgaccacaagtttgacctgatgtacgccaagcgtgccttcgtccactggtacgtcggtgagggcatggaggagggagagttctctgaggcccgtgaggatctcgctgccctggagaaggactatgaagaagttggtgctgagttcgacgagggtgaggacggtgatgagggcgatgagtattaagcctgcctcctggtgctttcccaaggcttgctactgctatcctatgatct

SEQ ID NO: 8085 - DNA, 502 bp, Triticum aestivum
  Clone ID: LIB3281-059-P1-K1-C9
cggacgcgtgggcacccactagctcccagctgcagcaagcaagccaaacttgtgcgtgggagtgagtgagcgagagctgagggaaaccaccctacaaagctccggctgagccacccaaccggccggcgacgatgccgatgctcatccccgacgacgtgcgcgccaaggcggagatctacaccggcgacgcagcggggcaggagaagacgcggctgatgctggctgagacggagcttcccagcggtctcctgccgctcaaggacatcatcgagtgcgggtacgtggaggagaccggcttcgtgtggctcaagcagaagaagcgggtggaccactacttcgtcaaggccggccgccatgtctcctacgccaccgaggtctccgccatcgccgagaagggccgcctgaagaagatctccggcgtcaaggccaaggagatgctcatctgggtcaacctccacgagatctgcgtcgacgacccgcccaccggcaagctccactgcaa

SEQ ID NO: 8086 - DNA, 557 bp, Triticum aestivum
  Clone ID: LIB3281-059-P1-K1-D1
tgcggggacgcgtccgcccacgcgtccgcacaccgccgcaacaaccactatcagcaacacacacacacagagaagcgaggatgtctggccgcggcaagggagggaagggtctcggcaagggcggcgccaagcgccaccggaaggtgctccgcgacaacatccagggcatcaccaagccggccatccgtcgtctcgctcggaggggcggcgtgaagcgcatctcggggctcatctacgaggagacccgcggagtgctcaagatcttcctggagaacgtcatccgcgacgccgtcacctacaccgagcacgcccgccgcaagaccgtcaccgccatggacgtcgtctacgcgctcaagcgccaggggcgaaccctctacggcttcggcggctaggcctgcgcccgctgctccagtctccgtcgactctgactctgctagctgctgttctggtgctatgcgtttcgtttctgaatgcgtgcgtgcgtgcgttgctgttccatcggtctgtgtagttagtggatggcgatggatctgaatgcagtaagttcgtcagagtgc

SEQ ID NO: 8087 - DNA, 568 bp, Triticum aestivum
  Clone ID: LIB3281-059-P1-K1-D11
ggaaaaaacagaggctcagcggcggcgatggctagcggcggcggcccgatgacgaagagaggagctgggcgagacccacgacgtcctccgcttcggcgtcaacgacagcgtccgcggcgacctcgcgccggcgcaccccgtccaggccaccatccacaaggaggccaagttctgggacgagaagaagaagttcgggaccgaggccatctacggatccgccttcaacatccgcagggatctcgacgcccagatcctctccaggttccaaaggcccccaggtgcattgccatcatctatgctaggatatgaggcgatgacaggttccttggatgattttggatttgaagattaccttaacttgccccaagactctgacagcctccgcataccggacatgcaccacgggatggaggttcgccttggcctgtcgaaggggcccatctgccccagtttcaattgattccacccatgtattagtcttgtgatacgttgtgctccccgtccagtatctataaccagtcactagactgtatcatggatttgtgaaacgtgagaactaaattggcat

SEQ ID NO: 8088 - DNA, 521 bp, Triticum aestivum
  unsure (1)...(521): unsure at all n locations
  Clone ID: LIB3281-059-P1-K1-D12
cggacgcgtgggcggacgcgtgggcgcgcgctctctggactcccaggtcacacaccgtgcttcccctcccctggtctgggggccgcgccnatccccccaccagcgcagcagcagccatggcgaccgcctacaacctccggtcccgcgacgagccggacgacttcgacgagttcgactccacgccctacggcggcggctacgacctcttcgtcaccttcggccgcccgctcccgccctccgacgagacctgctacccctgctccggcccctccacctcctacgacgcgccccactacgccggcgaggagccctccccctacgcccaccaccagaagccgcagcccgcctacggcttccgcccccagaacgagcagcagcagcagccttcctacggccgcgaggacgacgactccggctacgtatccaagcccaagcccaagccccagcccgcgtacgggttccgcccccaggcggaggaggagcagcgcccgtcctacggcggcggcggggaggaggatgac

SEQ ID NO: 8089 - DNA, 537 bp, Triticum aestivum
  unsure (1)...(537): unsure at all n locations
  Clone ID: LIB3281-059-P1-K1-D2
cccacgcgtccgctcaagaggaagcgggaggtgttctgggccgccgagaagaaaaccagcgggcgtctatgagaagaagaagtgcagcnagaacatcaaggtcatctacgcccgcgccaagcagtacgccgaggagtacgatgcccaggacaaggagttggttcagcttaagcgtgaggcccggatgaagggtgggttttatgtcagtcctgaggccaagctgctgtttgttgtcagaatcagaggtatcaatgccatgcacccaaagaccaagaagatcttgcagctgttgcgtttgaggcagatattcaatggagtgttcctgaaggttaacaaggccaccatcaacatgctccgcagggtcgagccatatgttgcatatgggtacccgaacctgaagagtgtgagggagttgatctacaagagaggttatggcaagcttaacaagcaaaggattcctctgaccaacaacaaggtcattgaggagggtcttggaaagcacaacatcatttgcattgaggaccttgtgcacgagat

SEQ ID NO: 8090 - DNA, 550 bp, Triticum aestivum
  Clone ID: LIB3281-059-P1-K1-D3
cggacgcgtggggagcaaatgacagagcttgtgttcatctttcgacacagtgaatcacggaggaaggaacttgaaaagcagagcaagcagaaagagcagacagctcccatggctactacacctccgggaagcgtaaatggctccgccaagcacactgcagatgactccaacacgccactatcgccggttgcagttcccgcacagaagcagctgaagtactctgctggaattgtaaatagccccagcaaaggcgtagctgcattgaacaaacaactcaagatggttcctattgcgcagttgcctgtcggcaagaaggcttcgatatcagggcaatcagggaaactctggagatggaaaaggagccaccaccagtggctactgcagttcaagtggaagtggcaaaagccctggaaactgtcggaaatgatccgccacagcgacgaaacgatcacgagggccaggcccagaccccagctacttatcactcataaacctcggaaagtgatgtgaaacaggcttctctttttttctccggcttcacattgactga

SEQ ID NO: 8091 - DNA, 536 bp, Triticum aestivum
  Clone ID: LIB3281-059-P1-K1-D4
ctcgcatcgctccgaccagatccgataggcgccttactggcctcggatcaggcatgcatggcgcggtaccgccaccgtcaggcgccgtcgctgagatccatggcgttggcccgtggctggtgccgggaggcttggattcatgcgtgccccggttgtgggtcctggccgtcctcggcgtcgtgtcctaaaggtgcacaagagacctcgtctccactccaaggccatttgtactggcatggaggttgcttgccggccatccatgatggtaaagaccaccagcggcagcagggccagcaagacggcggccaccatcaaccgcttcttcctgtccccatcaccttccttcagccttctcccaccgtcgccaatcaagatttggtgtgcaaaggcacaatttccttctagggcttcatctgcaaatccacaaaagtatgaaaggatcaacttgtcgaagtggtagaagaagctagggtgaaaagagcaaagcagatctcacctgtggggagcgaggactcccgcagcccaccagttgccat

SEQ ID NO: 8092 - DNA, 540 bp, Triticum aestivum
  Clone ID: LIB3281-059-P1-K1-D6
cccacgcgtacgctgaaatcgatgcaacttaacttcacacacacaggccctgagactgcgggcaagcgggccgacaacttggtaatccaacctaccacgtggcctggagcaacgctccggattacaaacctcagcatcacactcaccatgcttgagggcgcgtgccagatgagccgacaactctaccagccaagtgacgagactcacaccctggaacacaaaggtgctctatagagctgccgatcgggcttccacacctgccccgaggccgggcactagacaagccaatggcccgaccacccaagtgaccaaaaccgacacccagcatcacagaggcgctctgtggaggccgctgctttggcttccgcaacggacttgaggccggacacctgcctagccaacgacagaactgcgggacaacacatgcctttggcgcttgatagaggacaaagcccgcaaggcgacacctgggggggggggtgtgcgacgactgttacgactcctctccgggtattggccggagaactcacgatccacatg

SEQ ID NO: 8093 - DNA, 568 bp, Triticum aestivum
  Clone ID: LIB3281-059-P1-K1-D7
agcagccagcagaggagcagccgcacacccgtccgcagccgtacgccgcagatccgcggccgcgctagggttttcgcgccgaggggagaggggagatggacgtggtgaaggcggcgcagctgtcggggcggacgctggagaaggtggtggtgcacccgctggtgctgctcagcatcgtcgaccactacaaccgcgtcgcccgcgacaccaggaagcgcgtcgtcggcgtgctcctcggcacctcctcccgcggcgtcgtcgacgtcaccaactcctacgccgtgccgtttgaggaggatgacaaggacccgaggatctggttcctcgaccataattaccatgagtctatgttctccatgttcaagaggatcaacgccaaggagcatgttgttggctggtacagcactggtccaaaactaaaggagaacgacttggatgttcatgcattgtttaccaactatgttcctaatcctgtcctggtgattattgatgttcaacccaaggagttgggaatacccaccaaagcatattatgctgtagaagaggttaaagagaatgcttcttagaa

SEQ ID NO: 8094 - DNA, 54 bp, Triticum aestivum
  Clone ID: LIB3281-059-P1-K1-D8
caaaacccccggcgacccacacgtacccccacccatcctatcacccctcccaca

SEQ ID NO: 8095 - DNA, 567 bp, Triticum aestivum
  Clone ID: LIB3281-059-P1-K1-D9
cccacgcgtccgcccacgcgtccgagacaaatcatatgaatgtgaggatccgcacatggggatggtatatgcttctacgatgggctttgtcagcctacctagcctaccaccgtacgtggaagcctttcaatcccatccttggagagacgtatgagatggttaaccaccagggtattacatttattgctgagcaggtaagtcatcatcctccgatgggtgtagctcactgtgagaacgatcattttacttacgacatcacatcgaagttgaagacgaagttcttgggaaactcagtggaagtgtatccagttggaaggactagagtaacacttaagaagtccggtgtcgtgttggaattggtaccaccactgaccaaggtcaacaacttaatatttgggcgcacatgggtagactcttttggagagatggtcctgacaaatctgacaactggagacaaagccgtgctgtatttccagccatgcggctggtttggggctgggcgattcgaggtggatgggtatgtatatactgcagctgaagaaccgaaaataatgatgacaggaaaat

SEQ ID NO: 8096 - DNA, 571 bp, Triticum aestivum
  unsure (1)...(571): unsure at all n locations
  Clone ID: LIB3281-059-P1-K1-E10
tcttgcagtcgtccaacctccgcaagttcactttcagtgagctgagaagctccacagggggttccggactgacagccgggtcggngaggggggcttcggctccgtgttcaaggggtggatcgacgagcgcacgtttacgccggtcaagcccggcaccgggatgatcgtcgcggtgaagaagctcaagctggacagtttccaggggcacaaggaatggctggctgaggtcaattacctggggcagttgtcacaccccaatcttgtgaagctcatcgggtattgcttggaggacgagcagcggcttcttgtctacgaattcatgccgaagggtagcttggagcaccatcttttcaggagagctccacatttccagcccctttcatggaatttacggatgaaggttgctcttgaggccgccaggggacttgctttcctgcatagtgatgaggctaaagttatataccgtgatttcaagacctctaatgttcttcttgactcggaatataatgcaaaactctctgattttggcttggcaaaagatggcccgagtggcgataaaaagtcatgtttt

SEQ ID NO: 8097 - DNA, 564 bp, Triticum aestivum
  Clone ID: LIB3281-059-P1-K1-E11
ttgacctcgctgccaagaacggcgatgtatttttcatcacagaggtgatggcgaaggagggagaggagatggatcaggggcggattaagctagaggaagaagaggaggcccggaagagagaagaggccgcaaggcaggcctttgacccgaaggcaaagttcagcaagttggatgaactgctgacgcagacacagctctattctgaatttctccttgagaagatggagcagatcacagatgttaagccgactgctgttgaaattaaagatgaagaggaaccagtggaagagcaaaagaaaggacggggcaggaagaggaaagcggagaactctaagccacagtacaatgacaagaaggctaaaacggcagtggtagccatgctttcaagatctcgcgaagatcgctctgctgatgatggcactctcacggaagaagaaaagtgggaaagagagcaagccaaccttgttccattgttgactgggggaaagttgaaatcttaccagataaagggtgttaagtggctaatatcactgtggcaaaatgggcttaatgggatactggctg

SEQ ID NO: 8098 - DNA, 555 bp, Triticum aestivum
  Clone ID: LIB3281-059-P1-K1-E12
cggacgcgtgggcaatcccctcatcgcctcctttcccacgccgccgaatccgagaccgggtctcggattcaccgggacgaggccctcaggcgatccccggcacctcctccccgacgcttcagccatggcaggaatggcaccggaagggtcccagtttgacgctaagaactatgattctaagatgcaggagctgctgaaccaaggtgagactgaggagttcttcacctcttatgatgaagttcacgagagctttgatgacatgggtctccaagagaacctcctgaggggaatttatgcttatggttttgagaagccttctgccatccagcaaaggggaatcgttcctttctgcaagggccttgatgttatccagcaagcacaatctggaacaggaaagactgctactttctggtctggaatcctccaacagcttgactatggtttggttgagtgccaggccttggtccttgctcccacccgtgagcttgcacagcaaattgagaaggtcatgcgtgcacttggtgactacttgggtgtgaaggttcatgcctgtgt

SEQ ID NO: 8099 - DNA, 582 bp, Triticum aestivum
  Clone ID: LIB3281-059-P1-K1-E2
cggacgcgtggggagccctcgagcgagaacccttctgtcgtctccctcagaagcagccgcgggccgaatcaaatcgcgctggcagcctcgtccgcctcgccgtgcctgcgtccctccccggacggcggcgacgatggagggatccactggcgctggccaggcccccggccgatggacgcgccggatcgtcgctcctctgggccagcccctcccgccgcgctggatttcgtggcagcctagcttgtcagagatggcaaagctgttatatacagggtacggctccgagctagccgatgcctactgtatccagtgttctgttgcatccggtgcgacctcaaagaataccttcttctagctgggcgttgagcgccctcaggacgacgaggtgcatcgcctggggtggaagcagttcaactacacgatgaagaagtgagtgaaggggttaagaccgttgcgttgtgcgtgcgctgcttgcttgctgctgttgcatatagcttgtggctgtggttggccaacccggttatctctggctgcagaatcatcaaagaaaggatccactgctggtcttattggccttggtct

SEQ ID NO: 8100 - DNA, 571 bp, Triticum aestivum
  Clone ID: LIB3281-059-P1-K1-E3
gtcaaatcagtatttctattctgtagatatgcataaaaatgctatcagagggtattcatgagagaaatcatgtgacttcgatgcggatgacacatactgctttagcacaaagttgttatggtccatcattttcccttccgatgcagaaaggatttctgtctcagaagcacgaaagatgaatgaggttgttcatactcaagcaaagatcatagcagatcaagatgtgatgtataagtatttatcaaagaacttaatttttgttgctacggtgtctcctaaagctgctggtgaaattggatccgcggcacctgaagaagcttcactagtggcatatctcattgatgctgtcagcggacgcatactacaccgtgtgacccatcatggtgcacaaggccctgtacatgccgttgtcagcgagaactgggttgtctatcattatttcaacctccgagcccacagatttgaaattgcagtgattgagatatatgatcaatctagggcggacaataaaaatgtattgaagcttatacttgggaagcacaatttgtctgcacccatgacttcttattcc

SEQ ID NO: 8101 - DNA, 548 bp, Triticum aestivum
  Clone ID: LIB3281-059-P1-K1-E4
aacaaccaaaataggtttattattatatattctgtacagaacaaaacaggggaaactccatacactcggggcatcacaaccactagtttaaccgtcaaatattgcatgcctaggaacttcaaacttcacgtagataaccatacaatattccacacaatcacaaatattgcgatcgacaaataaaactctctgccaatgtaaagctagctactcttggataacaaactccctgccaatgtaaagctagctactcttggataacacggaacatgctcttcaacataggaagaagtcatcaatggagttctaccaacaacacaagctccattcaccttcaaagtacatgaagacaccgtcctttcgacgccatcgcttgtgctgcctgacaatgacaacaggcatgagcttcttcctccagtcagactttcccttcttgacaatggccataaccatgtcaccaacacaagcaaaggaagcctattcaggcgccccttgattcccttgacggagatgatgtacaagttcttggcaccagttttgtcagcaca

SEQ ID NO: 8102 - DNA, 307 bp, Triticum aestivum
  Clone ID: LIB3281-059-P1-K1-E5
gtgatccaagggctgcatattttaggcaggctattaatggcctctacataaggatggcgctgctcaaacttctgcttgttggccattgacattatttttcctggtgcgtgagctttgtgatgtcaaaggatcagaaatgtagtcttaatcgttggctcccaagttcaactgtttggtgctgtgcaaggtataagaaagttggatccttgcaagaataaagcaatgattgtatgataaatgctccataggaatattctctgttattatgtggaacatccttttccccaggatggaatgcaatgttgga

SEQ ID NO: 8103 - DNA, 566 bp, Triticum aestivum
  Clone ID: LIB3281-059-P1-K1-E6
ggtggttgttctcattcggatgctattagagcattttcgtttagtgctgatggcgccctgtgcgcatctgccgggatggtgggcttgtgaagatctggaagactgactcatggcgctgcatccagactataacttctgaaaagagggttagcgcagttgctattagcaaagatggcctgtatgtgacatttgcagataaatttggtgtcatttggttagttacggtggggggacatggcgaagggcaggtgtcatccgataacaaacctgtctcaatttatggtcactactgcagtattattactagcatgaaattctcaccagatggacggttcattgccactgctgaccgggacttcaaaatccgagttacatcattcccaaaggatcctgtaaaaggggctccccaaatacagagcttttgccttggacatacagaatttgtttcttccattgccttcacaagcctttcaggaggatcaagctttctattatctggaggcggtgattctactgttcggttatgggactacataaatggctgcctccttgatacatatgaagtc

SEQ ID NO: 8104 - DNA, 437 bp, Triticum aestivum
  unsure (1)...(437): unsure at all n locations
  Clone ID: LIB3281-059-P1-K1-E7
cccacgcgtccgcccacgcttnctctgactttttttgccgcccttttttttttaaatgtgaaaaaaaaaacgaattggggcaaattaaaaaaactaatcttttcaaattaaacctattaaacaaaacccaccaatacaatacatacagaacaaactttacaacacattgggtccaaaataaataaacgtttttattacacattaattaaccatatatattccacatgaaataaccatccacaggcctcttcaaataataaatcacccctcttctcacttaataaaaaaatccagatcttactaaaatataaaaaacagttatggataacatatccaaacattctaccttttatttttacaaatcattaaccaaaattttcctattgccacttaccaaaatttttttttttttacttatgcaaaaaattttttttttt

SEQ ID NO: 8105 - DNA, 497 bp, Triticum aestivum
  Clone ID: LIB3281-059-P1-K1-E8
cccacgcgtccggagtgactggtgagtgaatttttagggggaagaggaatggcgcgaggcgtggcggcggcggtgtcggcgttgggggtcgtggcggtgctcttgaccgccgccgcggcgaaggtctgcacgaacacgttcccgtcgtcggattcggtggcgacccacgcggagcgcgccgcggggcagctgcggctgcctgccgggctcgccggccgtggccacggtcacgggcacgcccacgagcagcacctcaccccgaccgacgagtccgcctggatggagctcatgccgcggaggctcctaggcggcggcggcggcggcaccccgccacgcgtggcgttcgactggctgatgctctaccgcaagctccggggcggcgctgtcgccgtggacggccccgcgggtccgttcctctgggaggcgtcgctgcacgacgtgcggcttcagccggggaccctgtactgcaggcccagcataccaacctggagtacctg

SEQ ID NO: 8106 - DNA, 473 bp, Triticum aestivum
  Clone ID: LIB3281-059-P1-K1-E9
ctgcagcttaatatgatgacagacgaaacattttcatctgttacagaagttatcgaagaaggcatactatgatagggtggtgaacagctcacctgtatagactgactggcctcttcgcagcctaggcacacacaagtgttcctcctcgtcccctcgtgcgccgcagatgacctgcagtcgtcttgcaactaaccaagcatggtgtcattctttcttttcttttccttttgcccccctgttgttgtcgcgcatcttttgtgtgtgctccttgccgcctctcaaaacacgttgtttacttagccaattcaaattgaatgtaaaataacatcatagggaatgtactgtgtgtgcgtgtgtgtgtttgtaatttgtactggtaccagtcatagtcagtcaccacacatgcctaaatcttaagaagcttaatggaacgtaccgtcgccatgccgtttggtttgtgcctcctgtgtctg

SEQ ID NO: 8107 - DNA, 405 bp, Triticum aestivum
  Clone ID: LIB3281-059-P1-K1-F1
cggacgcgtggggcgaaggagagggagatgcatgagaagctcatggcgaggcatgccacggtggttgacagcgtcgagaagaagcagcgcgggcaagacatagaaaaccggatttcctcccagcagcagaagatcgctgcgctgaggcaagaggtcgaatctcttctagagtaccttagcgagatatgagcgaatccggtctcatcttacatgattagtgattagactgaaggtcatcttctgcactttgtgtagatgttgtgttggtaacccattatcctagttcctgaggctaggtttcctagactctgtaatgtgatataagcgccttaatcattttggaactgattaatttttttgcatcatctaaaaagaaatcatggggaaccacccccttgggactcc

SEQ ID NO: 8108 - DNA, 572 bp, Triticum aestivum
  Clone ID: LIB3281-059-P1-K1-F10
ggcacttcctcctcgccttgcgcgaatgggccttcgcttcgcccacctcgccggcggggtggcccgagccgcgatctgtggccgtgggccacacctctccccagcgtgcgcccgccgcgtgctcgcccctctcgcctcgccgggtgagccaagcggcggcaactggctcgtcccttcccgcggccacggtggccactccaaccaccacggcgaggaaagcgtcgaggcatctgagaagatcttccgcttgggcctcgctgctgacgtcgtcctcaccgtagggaaagccatcaccggttacctctccggcagcacggccatcaccggcgacgccgctcactccctctctgacatcgtgctgagcggtgtggctctgctgtcgtacaaggcggccaaggttcctagagacaaggatcatccgtatggtcatggaaagttcgagagtttaggagctcttggaatttcaagtatgctgttgattactgcaggtgggattgcctggcattcttttgaagttcttcagggagttatgtcttctgctcctgatataattggcagcacatcgcacatga

SEQ ID NO: 8109 - DNA, 528 bp, Triticum aestivum
  Clone ID: LIB3281-059-P1-K1-F11
atctaggagaaacttttcttagctggtaagtcacaaaacagaactacatggaaattttaaacctcatgacagggcaccatttacatgggtgctagacattactgcccttcagggctgcgcaatttaaaaatcggattgaacaaaaaaacaacacacctgagaatccaatgacgttggtttgcatcatcactggcgaagcatcctacttcttggttgtcaacactcaatgatacaggctctcacagaatttatttaaaatacctcggccgaatgctgattagtgctaagtcactgatcaaccagacattgctacctcttgcactaccattgagccattttcttcctcctcttcttatcggccttcggctgctttggcttccgagcttttatatgtgcttcttgcactgtctttttctactccttccgagcagacttgctgtgctaaggtcccatcttgggatcagcctcataccttaaatctttaccagaactagagcatgatccactacttagcaatgagcatttatt

SEQ ID NO: 8110 - DNA, 555 bp, Triticum aestivum
  Clone ID: LIB3281-059-P1-K1-F12
gagagagagagagaggaagaggcgagcgtttttcggtcgttcggtgtgaggaggaaggggaggagatcgccggagaagagggggcgcaccagaagagatgtttctggtggattggttctacggggtgctggcgtcgctggggctgtggcagaaggaggccaagatcctcttcctcggcctggacaacgccggcaagaccaccctcctccacatgctcaaggacgagcggctggtgcagcaccagccgacgcagtacccgacgtcggaggagctgagcatcggccagatcaagttcaagaccttcgatctcggtggccaccagatcgcccgccgagtctggaaggactactacgccaaggtggatgcggttgtttacttggtggacgctgctgacaaggaacggtttgcagagtcgaagaaggagctggacggccttctttcagatgactccctagcgaatgtgcctttcctcgtactgggtaacaagattgacatacctatcgcagcatccgaggaggagctgcgctactaccttgggctgagcaacttcaccac

SEQ ID NO: 8111 - DNA, 545 bp, Triticum aestivum
  Clone ID: LIB3281-059-P1-K1-F2
cccctccgacctaggctatggctttcatcgtgtttaagctcgcgcgggcagccctcgcgtgcggccccgttggagatattggtggtggcatctccccgtgtctctcccggctctatctggcggctggtaccagccgtcgcatgtttgcagctgcaggcggtcccaagtcaaaagaagcaccccgaatatttccccttgttgatgagaattccattaagtcgaaggaatccctatgggccttgtatgaatgctggtgcaagtattggggggtatcccgtgaccgtgaagagatggtccgccggatcaagtcatttgaggctactgcacagtgggtttacaaaatgaacaactctgggtgttcgcaagtgtctcaactgggcccgcatgcaaatttttcagagagtgagtttgctgaggtggtgtttcctccacttcctgatgatgatgatgaagacataaaagagatggtgccaggtcaagatttgggccaggagcttgaggagcccttaaataattaattcgagaaattatgaacttgtcttact

SEQ ID NO: 8112 - DNA, 686 bp, Triticum aestivum
  Clone ID: LIB3281-059-P1-K1-F3
cccacgcgtccgcggacgcgtgggcggaggccttatagggagaaggaagatgatactcggggtgctcttcgccaactccgagggcaacatcctcatcgagaggttccatggcgtccccgcggaggagcggctgcactggcgctccttcctcgtcaagctcggcgccgagaacctcaagggcgccaagtccgaggagctcctcgtcgcctcccacaagtcggtctccattgtgtataccatgatcggggacgtctgcctgtacattgttggcaaggatgaatatgatgagcttgctttgtcggaggtgatcttcgctgttacgtcggcggttaaggatgtgtgtgcgaaaccacctaccgagcgcctcttcctcgacaagtatgggaggatctgcttgtgccttgatgagatcgtttggcaggggttgctggagaacacggagaaggacagggttcggaggctgatcaggctgaagccccccgtggagccatgatttttgcagttgagagatggatccttgctgggtatgtatcgctttgttagagccttgatgataactcaccaacactgggcacttgggtgaatcttctggcccgccttgacctgggtaccaacaaattttttgattgaaaatgttatattggacagatgggtttcaggtcccaaaaaaaaaaaaaaaagggccg

SEQ ID NO: 8113 - DNA, 571 bp, Triticum aestivum
  Clone ID: LIB3281-059-P1-K1-F4
tgggcgacgcgtccggggacccgcccattcgttgtggacttcatgaaacaaattggccaggctaatcgtcgtggggttgctactgatgaatgggtgggggtgcgtgaatgtgatgatgtttatgcagtaggtgactgtgctaccataaaccagcggagagtaatggaggacatctcagaaatattcagagttgcagacaaagataaatctggaactttgactgtgaaagaaatccaagacatcctggaggatatctacgtgagatatccacaagtaaagctatacatgaagagcaagcaacttaacggaattgcagatttaataagaactggcaaaggtgacaccgaaaaggaatctgtagagctgagcattgaagagtttaagaaggctctttcactcgtggattcacaagtcaagaatctacctgcaacagctcaggttgctgcacagcaaggacagtatcttgcgacgtgctttaacaagatgcagactgctgaagaaaatcctgaaggaccaatccgcattaggggagaaggccgtcatcgtttcaaccccttcaggtacaggcatt

SEQ ID NO: 8114 - DNA, 561 bp, Triticum aestivum
  unsure (1)...(561): unsure at all n locations
  Clone ID: LIB3281-059-P1-K1-F5
ccgncactccacccgcagcggcaaccatggcggtcggctttaacaagcgcatctccaaggggagggagggtagcaaaaagaaggccggggatcccttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcaccattggcttcacgaagagacgcccaaaccaggtgaagcgcacttgctatgcccaagcaagtcagatcagacagatcccccgcaagatggttgagatcatggtcaaccaagctgcaagct

SEQ ID NO: 8115 - DNA, 548 bp, Triticum aestivum
  Clone ID: LIB3281-059-P1-K1-F7
ccgttcggaatcccggcgcgcctccgtcacaggaaatccgacctccattcctcacgctgtttccccgccgtagccgccatgccgggcgctgtcctgctcgtcgtggcttgccgcccatccctcaccgtagcctccccagtcgccgccgcgcgtcctgcaacaccctcttatctcctcccactcggccaacgctaccccagcaacgaccccgaccaccgtccccctaccacgacggtcgtcaccgtcttccgcatccgccgcttcggcccccacttcctccgcacccaaggccacgcgcacccccacctcaaccaccaccaccgccaccacctacactccatccccgccaacatccagatccgccgccctgagctcccagagcttccccactccgcggccggcgttgccgcgagcatccaggagcgcgttaaggacatcctcgtggtcctcgtcgggatcctcttcggtctcggctgcggcgccctcaccgctgcctccatgtacctcgtgtggtccgtaatcgccggccccggcgcgttcttccacta

SEQ ID NO: 8116 - DNA, 569 bp, Triticum aestivum
  Clone ID: LIB3281-059-P1-K1-F8
cggaagagatggccgcggaggcgagtactccgtcgccggccgaggccagcgcgaaggggtggcgccgtcctcttcgtctggctcgggaacatttgtaggagtcctgcagctgaagccgtcttccggaacctcgtcagcaagcgcggacttgagtccaagtttcagatagactctgctggtaccataggttatcatgagggagataaggccgactcaaggatgatatcaacttccaagaagcgggggattgaggtgacctcaatatccaggcctatcaaaccctcagatttccgaaattttgatcttatccttgcaatggacaggcagaattatgaagacattttgagctcatttgacagatggcaacacaaggagactctcccagatagtggacccaagaaggttaagctgatgtgctcctattgcaagcggcatacggagtctgaagttccagatccttactatggaggcgctaagggatttgaaaaggtactggatctgctggaagatgcatgcgagtcattacttgacagcatcgtggcggagaaagaaaacgtttctgcttgatc

SEQ ID NO: 8117 - DNA, 528 bp, Triticum aestivum
  unsure (1)...(528): unsure at all n locations
  Clone ID: LIB3281-059-P1-K1-G1
gaaggaatggagattgacagaggatacatctcttctcagtttgtcacaaactctnagagggcggttgttgagtttgaaagcgctcnanttcttgtcactgatcagaagatttcctcgattaaagaaatccttcctttgttggagcaaactacgcagttgagagcaccacttctcataattgcagaggatgtatctggtgaggctttggcaactctagttgtcaacaagcttagaggaattctgaatgtagctgcgattaaagctcccggttttggtgaaaggcgcaaggctctccttcaggacattgccattgttacaggtgctgaatttcaagccaaagatcttgggcaactgatcgagcagacaacagtggagcagctcggcatagccaggaaggtgacaatctccgggtcatccacaaccataatagcagatgttgccaccaaggatgagatccaggctagaattgcacagctgaagagagagctttctcagacagactcgacatatgattctgagaagctggcg

SEQ ID NO: 8118 - DNA, 462 bp, Triticum aestivum
  unsure (1)...(462): unsure at all n locations
  Clone ID: LIB3281-059-P1-K1-G12
ctcttccatgccctggccatccaggaggagtgccacggctatcgcagttctccccatcgcatccctgatgggatgctgggggatgttnatcgtgtccttgcaccggcggcagccggagcctggtacgtccagagaggcatggccttggattggagcattgcaggcatcgatccacttcgtggtagccatggggtagggtggcgtagagctcagccgcgtgagctgcagttcaccagttcattcctcacctgtaagcctagcaagaaggaaaatggtttgtgctatatatacgactgaactggacaattgcatagaatgtagatatttgcacatctgatttcttttgtgtagtctgggtactcttccccatggtgttaaaaatatatatgtttgtgagggtgtatgactaacgtgattttgtaacacactaagttaacccaaactggcttgaatttgttggtt

SEQ ID NO: 8119 - DNA, 574 bp, Triticum aestivum
  Clone ID: LIB3281-059-P1-K1-G3
caccactcctccaatccgacaatttctcgcagctctaaccaaggcgagttcgtcagcaaggggtccggacgcggcgaagggaggcaaggggctcatcaagggcggtaccaagcgccacaagaaggtgctccgcgacaacatccagggcatcaccaagccggctatccggcgccttactcggaggggcgacgtgaagcgcatctcgttgctcatatacgaggagacccgcggcgtacataagatcttcctcgagaacgtgatccgcgacgccttaacctacaccgagcacgcacgcctcaagaccgtcaccgtcatggacgtcgtctacgcgctcaagcgccagggccgtaccctctaccgcttcggcggataggcccctcgtggacgtcaatcttcgatgcccccctgcagattcctaaagctcgatgagaacctgactcgtttagttcgctatttcccctgtagttccaagagaatcatgaaacaaagctattcgcatatggagattggaaattgcacttgtctttgtgcaaataaactgtttgtgatttaaaaaaaaaaaaaaaagggcgcc

SEQ ID NO: 8120 - DNA, 582 bp, Triticum aestivum
  Clone ID: LIB3281-059-P1-K1-G4
cccacgcgtccgcccacgcgtccgcggacgcgtgggcggaaagcaccgccagcgccgcagggccccgcgaatccgcgcccgggtctcccggcccggcggcgatggcgctctccgacctctcccgcgactcgctcctccccagcttcctctactcctcgcgctccttcgccgccgccgccccgcgcttcccctcctccccgtcgccctaccaggcgcccgcctcgcccgccgcggccccggctgctggcctcgtcggcgctggcggggtcgggggcagcaggcccttctcgatccgcgcgcccaacgagaagatcgtcatgtactcgccggccttctacgccgcctgcaccgccggggggatcgccagctgcggcctcacccacatggccgtcaccccgctcgacctcgtcaagtgcaacatgcagattgacccggccaaatacaagagcatcacatctggatttggtgttctgtttaaggagcaaggagctaggggattcttcaggggatgggtgcctacgttgcttggttacagtgctcagggggcttgcaagtttgggttctacgagttctttaagaaga

SEQ ID NO: 8121 - DNA, 492 bp, Triticum aestivum
  Clone ID: LIB3281-059-P1-K1-G5
cgcatctttctcacctccggcgaaaaacacaccagagctcgcatctcccctcgattcctagctgcaatgtcgactgaagtggctgctgctgacatcccggtgcctcaggtggaggtagccgccgacgccgccgttgacacgccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaacttccgcaagatcctgctcacccagatcaagaagctcgtcgccgctggcaagctgaccaaggtcaagggctcctacaagctggccaaggcccccgccgccgtcaagcccaagacggccaccaagaagaagccggccgccaagccc

SEQ ID NO: 8122 - DNA, 520 bp, Triticum aestivum
  Clone ID: LIB3281-059-P1-K1-G6
gctcccttgcagaaccttgcggcgacgattctccaaaggaggttgggcgccggcgccggagacctcggcgtggtagtgaccgcgcgcacctgcccccgaccggcgtccccccgatgtggcggctgcccgggctgctctcccaggccgccgcggccgggagggcggcggcgaggaccagcagcggccacgtcaggggttccaaggggttctccagcggaggggacggttccccgctgccccgggggtggctgcgaaggctgtggatcgaggagctgaaaagggagaaggaagctgcgaggagactggggggaggcgccttggtctgcaaggccgaaggtgtcggcgaggatccgctcggctatttggccaacgccgcgcgcgcgttcgtgaattccgggtccgccgcggcggggattgacaaggtgagggctggtggggcggcccgcggcgaggtggccccgtctaaaggcggccactatgaccccaaggaccttccatacctagaggccaaactggagcc

SEQ ID NO: 8123 - DNA, 559 bp, Triticum aestivum
  Clone ID: LIB3281-059-P1-K1-G7
cggacgcgtgggaaacaacagaaacgctccctccaaaatccaccttcccacctagttagcccatcaccctcctgcagagggggaacctccccaatccgtggccagcagaagcggcggcgtttctaggatacagatagtactttaaagggctaagctgcaaaacaagagatggatggcaaaaagaagaggaacaggaagaagaagggaaaccaagggaagaatactggtgatgcggtgaccaatgccgatgaagctgttcctcagagccacaatgatgatttggctccaaaagaaaattatagtggtgctgatgcagatgatgctgtgtccagtgttggagatgcagtgtccagtgttggagagggaacacagtaccagaatcacgagcagactccgcatgcaaagcagaatgttgcaaacactgatgaaaccatatcgtcgtctgttggtgaggtgattccatgtgacgagaatcacgaacctaccatgacacaggagaatcacaaggtcagtaatacagtctacgcagatcagaggagtattgggatttcagattcta

SEQ ID NO: 8124 - DNA, 570 bp, Triticum aestivum
  unsure (1)...(570): unsure at all n locations
  Clone ID: LIB3281-059-P1-K1-G9
cccacgcgtccggtcaaaataaaacacaagcacagtacccatcccctccgctccccccgcgcctccgcctgccggcgggggaatcctctgcggttaacaatggacgcgcagtacaaccccaggaccgtggaggaggtcttccgggactacaagggccgccgcaacggcctcgcccgcgcgctcaccaccgatgtggaggaattcttccggcaatgcgacccggaaaaagaaaatttgtgtctttatgggtttcccaatgagcattgggaagtaaacttacctgctgaagaagtgccacctgagctcccagagccagcattgggcatcaactttgcacgagatggaatgcaggaaaaagattggctatccatggttgcagtacacagcgacgcatggttactatctgttgcattctactttggtgctcgattcggatttgataaaagtgacaggaagcgcctgtttggtatgattaatgagcttnccacaatttttgatgttgttagtgggaagagtaaaaccaaggctccgaccaacaataaccacagcaatagcaaatccaagtccaac

SEQ ID NO: 8125 - DNA, 557 bp, Triticum aestivum
  unsure (1)...(557): unsure at all n locations
  Clone ID: LIB3281-059-P1-K1-H1
tggcgtgacgcgtccgcggacgcgtggggccggatccccaaacctcctttcggtccgacgcctcgtgccnccggcgccgacaggggacccctccgcgtgtcacgcntnccnccncccccgccgtcgccgtcccgtctccctcgccggggcatcgcgttccaccccgccggcgactaggaacacggcaccctgaagctcctgagctagagtaggaggggcaaaaccatccagctgaagaatgaaaacacatgagcgtgctgccaacttggctcttgctggtttgagcttggcaccgctcgtgatcaatgtgaacccaaatttgaatgtgatactgacagcatgtcttactgtctatgtgggctgttaccgttctgtcaagtcaactccacccgctgagacaatgtccaaagagcatgctatgcggttccctttggtggggagtgctatgcttctgtcgctattccttctattcaagtttctctccaaggacctggtcaatactgttctcactggctactttttcattcttggcattgcttcgctctgtgcaacgttgc

SEQ ID NO: 8126 - DNA, 361 bp, Triticum aestivum
  Clone ID: LIB3281-059-P1-K1-H11
cacacgcacaaggcgcacctaccggccaactttctcatgatcatgctcacccacatcaggaggctcgttgccggcggggggctgaccaaggtcaaggcctcctacaagctcgccaaggcccccgcagcgcccaagaagcccaagaccaaggcgccagccaagaagaagccggcggctaagaaggccccggccaagaagcccgcggccaagtccccagccaagaagaaggcctccgccaagcccaaggccaaggccccagccaagaccaaggccgccgtcaagcccaaggcggctaagaagcccaaggcagccgccaagaccaaggctccagccaagaccaccaatgccgccgcaaagccca

SEQ ID NO: 8127 - DNA, 181 bp, Triticum aestivum
  Clone ID: LIB3281-059-P1-K1-H12
aaaaaagggggcgcagaaaaaaaaaaaaaaaaaaaaaagaaaaaaaaaaaaaaaaagggggaaagaaaaaaaaaagaaaaagaaaaaaaaaaaaaaaaaaaaaaaaaaaaaaaaaaaaaagaaagaaaagaaaaaaagaaaaaaaaaaagaaaaaaaaaaaggaagaaaaaaaaaaaagga

SEQ ID NO: 8128 - DNA, 571 bp, Triticum aestivum
  unsure (1)...(571): unsure at all n locations
  Clone ID: LIB3281-059-P1-K1-H2
ggggccgagccgtccgccactccttccttacctcactcccgatctccctatcggcacctcgtcctcncctcntccgcggccgctccgaccgcccggggcgtcgcgcgcncccaccggcccggcgccgtggccacggcagcggagatggtgttctccgtgacgaagaaggagaccaagccctacgagggccagaagcccggcacctccggcctccgcaagaaggttacagtattccagcagcctcattacctcgcgaatttcgttcaatcaacatttaatgcccttccagctgaccaagtaaaaggtgccaccattggtgtctccggcgatgggcgctatttctcaaaggatgctggtcaaatcattgcaaaaatggctgctgctaatggagtaagacgtgtctgggttggacaagacagtctcttgtcaactccagctttatctgctatcatccgggaaagaatttctgcagatggcgcaaaggctactggtgccttcattttaacagccaaccacaacccaagtggtccaaccgaggactttggaatcaaatacaacatgggggaatggg

SEQ ID NO: 8129 - DNA, 552 bp, Triticum aestivum
  Clone ID: LIB3281-059-P1-K1-H4
gcggtgtaaaaaacaattgtttttcatattaaacttctatacttattttaaactaagtgtggcatattacaggtgtaatgggtgatatttttattagttagttatataaaatcttttcaaataatagttatattattcattggtatgcagttgtaatgtatatcattgaaaattataattctacaaaatgaaaattttatgatgcaccaaaaatttctttattggtgaaacaatctttcatatttttatttttctaatactgcataaatgatgtatgtatacacatttgcatatatatgcgtttgttcatatatcttttgatattatgttgaatattatcatagagatttctaaattatagacacactaacaagtatttttcttgtgatttctattgtatattaggcagtcaaattaatggaaacttctagggaatagaaaatgtgtcttgcatgttcggtttagtaattcgaagaaccgaaaatgttgttgattatactttcacgcatgattcgattacctaacatgctcggccagattcacttgttttga

SEQ ID NO: 8130 - DNA, 286 bp, Triticum aestivum
  Clone ID: LIB3281-059-P1-K1-H5
gccaaacgcaaggagtgggcggacaagaaagcaaagaagatgtcatgaactgtgcccaagggctcctgatgcctgatgctacgtttgttgtgtaacagggtaagacgagagtgatctaccctgtttgccgtctctgtgctattgaaagatgaactgaactgtagactgatatcatcttgagatgtgatacgcttgttgtatgacatcggtgtaagatgagatacgccatgtttggtgttgtgttcgtgttggggaagattttttatagaatgaacaataaagtaat

SEQ ID NO: 8131 - DNA, 533 bp, Triticum aestivum
  Clone ID: LIB3281-059-P1-K1-H6
ctttgccgctaagcaagccacacctcgggttcgaggcggcgagggtttgcgcgacgagggtgactgtaatgctctggcccgggtgatctctgccgtttcagattggggaactcgatttcgatttcgaccccagtgctggattcgtcgatggtgggggtgctgtcgaatcgggtgggccgggaggccctcgccgccggggatcacatctactcgtggagaaccggctacatctacgcccaccacgggatatatgctggagatggaatggtcatccattttacgagagcggttggacatgaaattgggacaggaacattcttagacaagtttctgttcagctcatcgccgactacggcggatggccctccttgcgagaaatgtgggcacctcatcaagcctcagggcgtcataatgtcctgtctcgattgcttcctggacgggggcagtctctacctcttcgactatgctgtgtcgccccctttcttcctcgccaaagcgcgtggaggaacgtgcactatggcactctctgacgc

SEQ ID NO: 8132 - DNA, 452 bp, Triticum aestivum
  Clone ID: LIB3281-059-P1-K1-H7
cggacgcgtgggccgacaccccggcgcgctgtcacgccatgatctcctcgacaagcgaggtccgtcgacttctacagagaaattcctagggatttgacggaggcatcactatctggcgctggattatccatatttgcagcactggcaatggtgtttttgtttggaatggagttgagtagttacttagcagtcaataccaccacatctgtaattgttgacaggagttcagatggggagttcttacggatagattttaacttgagctttcctgcgctttcatgtgaatttgcatcagttgatgtcagtgatgtgctgggaacaaacagactaaacataacgaaaactgttcgcaagttttcaattgatcggaatttagtacctactggatctgagttccacgctggacctatacccactgtcaacaaacatggagatgatgttgaaaaatacca

SEQ ID NO: 8133 - DNA, 504 bp, Triticum aestivum
  Clone ID: LIB3281-059-P1-K1-H8
gcagccgcagagcccgcctctagtaccgcaaggaaaggaggggaaaggaacctgttggcggcaatggcttcctcgcgcgcggccgccgcccccttcgcgctctgcattctgcttctcgcgtcccccgccgtctccgccacattcttgttcgacgacgggaagtcggcgtcgaagggaaaaagcaaggacaaggcggcggtcgacgtggagtggcggccggccaccgcgacgtggtacggcgacgccgagggcgacggcagcaccgggggagcgtgcgggtacgggacgctggtggacgtggtgccgatgaaagcacgggtggggtcggtgagcccggtgctgttcaagggcggcgaggggtgcggcgcctgctacaaggtcaggtgcctcgaccacggcatctgctcgcgccgcgccgtcaccgtcatcgtcaccgacgagtgccccggcggcggcccctgcggcggcggcaacacgcactttgacctcagcggcgccgccttc

SEQ ID NO: 8134 - DNA, 537 bp, Triticum aestivum
  Clone ID: LIB3281-059-P1-K1-H9
cggacgcgtgggggaaaaccaggctatgagcatctgagtgaacaacttcatatcttggtggaggctgagttcccagccggattattgatgccagattgagacatgcacaggaaattctagaagaactgctaaagccagtggatgagacacaggatatctacaagaggcaacagctcagggagctggcgatgctaaactcaaccctgagagaggacagccctcatccgggaagcgtctccccattcagcaatggtggcatgaagcgtgcgaaaacaggccagtagggaaggagccacccctcatcgttaccggtattgtccaggtgccttatgccccccaatggggacgccatgtctccgggcaacgtttgccgcgggcgcacttgaaggaagcgacgccctgcatttcgctagacgagtcagtatgagtctgcggtctctcctgcggacaaggagaagccgctgggacagtggaagtagtagagtcctgggtcggtgggtcggcccagctttgggttgctgtaaggtcctagaacat

SEQ ID NO: 8135 - DNA, 196 bp, Triticum aestivum
  Clone ID: LIB3281-039-E7-F5B
ggggaagtgtttgaagatactaatctctgtacccccacctgaccattttgtaaacccgtgttgtgaaacagttaatgcttcgggcacccctaacatttccgctttcattcggcacatcgacatgtttatgctggaactattcgtgcattcgtatggatttgtattcctccaaaaaaaaaaaaaaaatggatagtgt
